United States Patent 6,605,709 (NUCLEIC ACID AND AMINO ACID SEQUENCES RELATING TO PROTEUS MIRABILIS FOR DIAGNOSTICS AND THERAPEUTICS) - sequence listing, part 3

SEQ ID NO: 6344 - protein, 384 aa, Proteus mirabilis
VPFLMVKTSFIYGLAFASLFISHTANAQLFPDRQQIDQWLNQLGGSNNFDRSKTIDWGVLPGPFYTPELELGLGIAVVGLYQADSRPDSKISSLSLSGFGSSTGAFGMTFSNYTYLADDTWRFYLTGALNNVPTNFWGQGYHEGRVKKNFAQYRSQELHLTPTLLRQITKNTYIGLGWDYANLQAAAPDDEFKAYMSKRHLPLRSTSSGLSVRFTYDSRDFLPNARQGQAFDISYTHYSSDTGSNNRFNATQMQYNYYYPLTEDAVLAFDSYARFTSGDVPWTQLSKLSNGHQMRGYYEGRYQDNHVFSSQIEYRQKLNWRHGIALWAGGGTLSNQARDLGKGHWLPSVGIGYRFEFKPRMNVRLDFGVGKESTGFYFQVGEAF

SEQ ID NO: 6345 - protein, 643 aa, Proteus mirabilis
TVFSNSEPQIKTMTQSSYNAKDIEVLNGLEPVRRRPGMYTDTTRPNHLAQEVIDNSVDEALAGHATKVEVILYADQSIEVIDNGRGMPVDIHPELKVSAIELILAHLHAGGKFSNKNYQYSGGLHGVGISVVNALSKRIEVTVRREGKIYQIAFENGDKVEELHQIGTCAKRDTGTSVHFWPDSTYFDIPRFSSKSLSHVLKAKAVLCPGVNVSFTDKVNNTQETWCYADGLTDYLSEAVAEFVRLPEEPFTGKFEGDNEAVEWSMLWLPEGGDLLTESYVNLIPTVQGGTHVNGLRQGVLDAMREFCEFHNLLPRGIKLTADDTWERCAYVLSVKMQDPQFAGQTKERLSSRQTSAFVASAVKNAFSLWLNQNVQVGELLAEMAISSAQRRMRAAKKVVRKKLTSGPALPGKLADCTSQDLRYTELFLVEGDSAGGSAKQARDREYQAIMPLRGKILNTWEVSSDEVLASQEVHDISVAIGMDPDSDDLSQLRYGKICILADADSDGLHIATLLCALFVRHFPALVKQGHVYMAMPPLYRIDLGKEVSYALDEAEKNAILQRLSRKKGKPNVQRFKGLGEMNPLQLRETTLDPNTRRLVQLVIDDENYQETLGMMDMLLAKKRSEDRRNWLQEKGDEVDIEV

SEQ ID NO: 6346 - protein, 108 aa, Proteus mirabilis
TMTSEQHILARLLLIEEEMKNIGLWQLDAPNDEAFASSEPFCIDTMEAHEWLQWVLIPRLSSLIDSGMALPTAFAIAPYYEEAFKDDETRDYVDLLNHLRELDALFKQ

SEQ ID NO: 6347 - protein, 273 aa, Proteus mirabilis
INRLVKYLTHCYFANGSLFTIMNKRQITPIFYQLRLFSFWFTICLRKLYSLVSVKIFSCIDKKVENIMRKLPLLFLSLLGLGVSLSSHAETRYVSDELSTYVHSGPGNQYRIVGSLSSGATVTVLSRNAATGYVQIKDDKDRTVWLPENQLSTQPSMRTRIPAMEKEIQTLRDKLANIDQSWNQRTIDMQNKVSNSDEIINGLKKENEQMRTKLAVAEKKLDFANQQLDDRQRDIILQWFMYGGGVAGAGLILGLILPHIIPRRRKRNDRWMN

SEQ ID NO: 6348 - protein, 252 aa, Proteus mirabilis
VNLSSDDSSASKPKHVAIIMDGNGRWAKKQGKLRVTGHRAGIKAVRDAVSFSVKHKIESLTLYAFSSENWNRPEQEVSSLMELFVFALDNEVKSLHKHNVRLTIIGDISRFSRRLQDRIKNSVALTANNTGLNLNIAANYGGRWDITQSVQQLASSLAKGELAIEDINENAISSHLCLHDQSPVDLVIRTGGEHRISNFLIWQIAYAELYFTQVLWPDFDEQVFQNALDAFAKRERRFGGTTSETDTVNLGG

SEQ ID NO: 6349 - protein, 197 aa, Proteus mirabilis
AQISKRSNAVSKGISAIFLDRDGTINIDHGYVSEIDNFEFIEGVIEAMAELKAMGYALVLVTNQSGIGRGYYSEDQFLHLTEWMDWSLADRGVDLDGIYYCPHHPDAIIEEYKKECDCRKPATGMFMDAKAQLNIDMASSYMVGDKKEDMLAAKAAGVGHKILVRTGKAITEEAETCADFVLDSLADLPKWLKSHKK

SEQ ID NO: 6350 - protein, 415 aa, Proteus mirabilis
IMGSFDYIKQAIKKNGYTLQQVADESQMTKGYLSQLINNKIKSPSAQKMSALHQFLGLEYPLQQKTIGVIFGKFYPLHTGHIYLIQRACSQVDELHVILCHDEPRDKELFINSAMSQQPTVSDRLRWLLQTFKYQKNIRIHEFNEHGIEPQPHGWEMWSEGIKAFLQEKQIAPDFIYTSEREDASQYEAFLGIETVLVDPERSFMNISGSQIRQAPFKYWEYIPTEVKPFFVRTVAILGGESSGKSTLVNKLANIFNTTSAWEYGRDYVFSHLGGDEMALQYSDYDKIALGHAQYIDFAVKYANKVAFIDTDFVTTQAFCLRYEGKEHPFVQALIDEYRFDLVILLENNTPWVADGLRSLGSDKERRRFQTLLIEMLDKNNIEYIKVDPSDYDERFLRCVELVRELLMMQSKHIE

SEQ ID NO: 6351 - protein, 452 aa, Proteus mirabilis
MNMSSRKMRKTHNGKLMKNWKTLVIGLMITVGAATSTTTFAAQELNRVSAIVNNGVVLESDVNRMLQTVQMNAKNAGQEMPDEQVLRQQILERLVMDNIILQMAQQMQIDIPEAAVESTIQGIAAENNLTLEQLKKRLAADGIAYNDYRQDIRKEMMLAEVRNNEVRRRITILPQEVDSLAKQIESQASQSIDLNLSHILIPLSENPSPAEIEKAQQVVNRIKNQLKNGADFGKLAATYSADPQALNGGNMGWASIDELPTIFAKQLANAQKGEIVGPLQSGVGLHIIKVNDIRGASKTVSVTEVKARHILLKSSPIMNDEQAYAKLQKISADIRSGKISFADAAKEYSEDPGSALRGGELGWSMPDIYDPAFRDALMRLNKNELSQPVRSNFGWHLIELEDTRSVDKTDAANKEQAYRLLFNRKFNEEVQNWMQELRAGAYVKIMNENNAN

SEQ ID NO: 6352 - protein, 88 aa, Proteus mirabilis
GNMSTNTEYQPINCDDYEYLELACQRGLTLHIELHNGEQIDGVADDLFLSKKVEYLKVKTSEGAKDLRLDIIASFSHPELGTIIIKSE

SEQ ID NO: 6353 - protein, 60 aa, Proteus mirabilis
YFFFYLLKKITFSHSTIILFSNVFDNPPKSSIYCQLTCLIDLSIAKLSDENGATIGAFAD

SEQ ID NO: 6354 - protein, 264 aa, Proteus mirabilis
AIRSMMLDIIYQDEYLVAVNKPAGWLVHRSWLDRHETVFVMQTLRDQIGQHVFPVHRLDRPTSGVLLMALSSEVARTLSVCFEQHQMEKVYHAVVRGYVEEPMIIDSPLVEEHDKIADKFASHPPKIQHCITHCVPLAKVEKEVAIGRYPTSRFSLLELRPETGRKHQLRRHMSHIRHPIIGDTAHGDLRQNRGVVNHFQSHRLMLHASQLNLIHPITQQPLNLTAKWDLPWQHLINQFGWRGLKPELEQFGEDLAHHFVLSDI

SEQ ID NO: 6355 - protein, 72 aa, Proteus mirabilis; identical to SEQ ID NO: 5059

SEQ ID NO: 6356 - protein, 423 aa, Proteus mirabilis
VTYPWSTENDTGERIMKRVHIMVLDSFGIGAAGDAEKFGDQGADTLGHIAQAFAEGKADKDGRKGPLHLPNLCRLGLGKAAEESTGKFPVGLDKDAEIIGAYGYASEISSGKDTPSGHWEIAGVPVLFDWGYFKDLKNSFPQELLDNIVKRANLPGYLGNCHASGTVILDELGEEHMKTGKPIFYTSADSVFQIACHEETFGLDKLYELCEIARDELNKGDYNIGRVIARPFIGDKPGNFSRTGNRHDLAVEPPAPTMLKKLVDEKQGHVVSIGKIADIYANVGITKKVKATGIDALFDATIEEMKLAGDNTIVFTNFVDFDSSYGHRRDVVGYGEALELFDRRLPELMELVKEDDILILTADHGCDPTWQGSDHTREHIPVLVYGPKVKPGSLGHRETFADIGQTVVKYFGLSPVEYGKAMF

SEQ ID NO: 6357 - protein, 231 aa, Proteus mirabilis
FGDPLSSIFITILAAFSNNSLTGLGICVPINNISAIKMIIGSVVNRPNSPLATTSGFGPNTVLATIRTNPPNTTVNNNNNRIVNPICLAAKPATTIINSLIKTLNGGMPPNAKAPPANNAALNGITLNIPFTTFRSRVPYFSNTLPEPQNSNAFAKLWFNVWNKAAKIPIGPPIPRATAINPMFSTLEYANKRFISRWIRIKNAAIATERKPKINNRLRVNSVPIAASIIM

SEQ ID NO: 6358 - protein, 437 aa, Proteus mirabilis
FVMFISLNIKSLQHINNVLLDFDFSNRNLICITGRNGIGKTSIVKSLCLLKDISVLNKTSSIFSINKETNITISINKNNYHYYCNNGEIDSKDIIDESFLNVELPIPYGKRFSNFPVLGNIDKELRESYIKGEFNKNIEIIYFLSQIYIGERFSSLKEVIIRGNKYYFLPLDGYRYIREDYFSSGEYFVINLYKTVTSDCKLIVVDEIDISLDASAQVRLIQALNNLCDKYKKKIIFTTHSLPIMRVLYQQVGESIFYLENINSRLIMREVSYSYIVGELFGFKDYDKYILTEDIMLEIYLKRLISKIDTNKSVKIIYIGGASNVIDFMRRNKRENFICESKHMISFLDGDSRGKVSGDNILYSPFLDIEDEFFRKYTEENNRFNLPSIGVDNCKSKYYCKTVIKDIGYEAFFNILDIDFEDKIEQTIAELREFINK

SEQ ID NO: 6359 - protein, 236 aa, Proteus mirabilis
CLVFLLWVFWQVLYSQKKRINKVNNDNRYSWEIRISQHKLKRLKMSVSLSKGGNVSLSKAAPTMKNVLVGLGWDARSTDGQDFDLDASAFLLAANGKVRSDADFIFYNNLRSADGSVVHTGDNRTGEGDGDDEALKIKLDTIPSDVEKIIFVVTIHEAQARRQSFGQVSGAFIRLVNDDNQIEVARYDLTEDASTETAMLFGELYRHNGEWKFRAVGQGYAGGLGSVCAQYGINAS

SEQ ID NO: 6360 - protein, 495 aa, Proteus mirabilis
NINPKILYFFACKEKAMSLRYQRSALSVVVATLFTSVSFSSFAAPVTADTILAQDRAAKGNITEFGGARRITSDQTEALKAALNNHQAKNVILFIGDGMGDSEITVARNYAEGAGGFFKGIDALPMTGQYTHYSLDRKTQKPNYVTDSAASATAWASGVKTYNGALGIDVFGKDHQTILELAKANGKATGNVTTSEIQDATPAALFSHVTGRKCYGPVETLAKCSTNALENGGRGSISEQLLVTRADITLGGGAKSFAQTATAGEYKGKTLEQQAIERGYQIVKDAKSLEAITLANQDKPVLGLFHDGNMAVAWEGPKATYQGNLKNPPLECKPNSKLDPNAPTLAQMTKKAIDLLKTNENGFFLQVESASIDKQDHNANPCGQIGETVALDEAVQIGLDFAKQNGDTLIIVTADHAHSSQIIEADVKSSGLTQALITKDGAVMVVNYGNSETDSQEHTGAQLRVAAYGPHAANVVGLTDQTDLFFTMRDAMGLK

SEQ ID NO: 6361 - protein, 65 aa, Proteus mirabilis
FFLPLFTKNHPFIFTLVDFLLIKSFFLDYLIEIKDYYLIYFFCSILNTNCAYSHTKARPRLKWHV

SEQ ID NO: 6362 - protein, 257 aa, Proteus mirabilis
GLSLIKEGKVMISFSNKVGIITGGNSGIGLASAEKFLSLGASVVITGSHSGRGEKAQNYLQDKGFSAEFVQMDAANEQDNQQLVKYVVKHYGKVDFLFANAGVLTDTVADKLHYDQWKKVLDVNLNGLFLINRAVIQHWLETKTTGAIVNCSSICSFVGQHAFPAYCSSKGGIKLLTQTLALDYASQGIRVNAVCPGYIDTPLLEGRELDKQKLVALHPIGRLGTPEEVANVVAFLASDAASFVTGASYLVDGGFTA

SEQ ID NO: 6363 - protein, 266 aa, Proteus mirabilis
ETSLESFMTDLTAAARLALSLMDLTTLNDDDTDEKVTKLCHQAKSPEGNTAAICIYPRFIPLARKVLREQGTPEIRIATVTNFPHGNDDLDIALAETNAALAYGADEVDVVFPYRALMAGNEQIGFDIVKACKDACAKAGALLKVIIETGELKDPALIRKASEISIKAGADFIKTSTGKVPVNATLESAELMLQVIHDMGVGKEVGFKPAGGVRTAEEAAQYLALANRIMGDNWVDARHFRFGASSLLGNLLATLGHGEQKSSSGY

SEQ ID NO: 6364 - protein, 73 aa, Proteus mirabilis
AIALVSEHGTDSFFSSSTAPTTALSIPRFRSIGFMPAATAFKPSAIIACANTVAVVVPSPAASLALEATSFTI

SEQ ID NO: 6365 - protein, 221 aa, Proteus mirabilis
GFFTMNQTLLSEFGSPLERVERALEALRAGKGVMVLDDENRENEGDMVFVAETMTTEQMAMSIRHGSGIVCVCITEERRQQLDLPMMVENNTSHFHTAFTVTIEAAQGVTTGVSAADRLTTVRAAAADNAKPSDLNRPGHVFPLRAQPGGVLTRGGHTEASIDLATLAGFKPVAVLCELTNDDGTMARAPEVVTFAKQHDMPVLTIEDLVAYRLREEKKAG

SEQ ID NO: 6366 - protein, 365 aa, Proteus mirabilis
KMVTWRKSLLLGILALALTGCHRPTDQGQQYKDGKLKQDLIEVNSPNTQGKPINGSDYLEQINQINQTSSRLYNSNQDTYQAVENWLRSGADTRQLRQFNIAAFQMEGEDNYGNVKFTGYYTPVLEARLTPQGDFKYPLYRMPAKVRGKLPSRAAIYNGALSPTLIAAYSNSIMDNFMMEVQGSGYVDYGDGKPLTFFGYAGKNGHPYRSIGKVLIDNGEVEKEAMSMLAIREWADKHSEQEVRKLLEQNPSFVFFKPEPFTPVRGASAIPLIAKASVASDRSIIPAGTVLLAEIPILDNTGKFTGQYQMRLMVALDVGGAIKGHHFDIYHGIGKEAGQMAGFYNHYGRVWVLKKSQPTLLNPIQ

SEQ ID NO: 6367 - protein, 90 aa, Proteus mirabilis
RENTMRVLTIYCPECGEKAMIKKSNRKHKELTDLYCACRDPLCGHTFVLNLTFSHTLSPSAKKQDALLLAMIKNLSPQQREKALTLLQEI

SEQ ID NO: 6368 - protein, 167 aa, Proteus mirabilis
PKSTLSNINTIKEYFVITTQGTIKEQQGVIGLMAAVGFMVISLSLLTSFAYHYRQCQLMVMQELQAKQTFLFAGSALSWGMTLTWDLSPSRLYQWQCRTFTAEPNMKSCFSLRGKTSALLLGEAKSHSGDKISHYQWINLVGKEKLHIEAQPNGWLDYCPLVKEGCI

SEQ ID NO: 6369 - protein, 264 aa, Proteus mirabilis
MIITAAKQLTIGYKTTPLIQNLSFHIKQGQIVCLLGANGCGKTTLMRTLLGLLPSLAGHIIIEGKEISKWSPTDLAKVIAYVPQATHLPFSFKVIDMVIMGRGAHISFFSMPSSQDKAMAMETLEMLSLSHLAHRTFDTLSGGEKQLVLIARALVQQPKLLIMDEPAASLDFGNQIKLINQIKTLKALGISVFMSTHHPQHAALLADEVILLTPHRHVLQDKPELLLTPEHLAQLYNVKPTDIQAHFYAYPDNNNPYRQEYEHH

SEQ ID NO: 6370 - protein, 342 aa, Proteus mirabilis
LENTMFNLNYFKADSSTFIIKSVNGKVRQQGKGLSFWYNSATTSIAALPLNAQEAPFIFNFQTADFQALRIQGQISFQVTSPEKAAEVLNFNLSKNGKSYASEDPLKLNDRVVRIAQTLIQAKIQSTPLREALQLSQSLVTLVMKQLTEHPSLEALGITILDVSIAAISPSPETLKALEAEARESLLKEADDAIYARRKFSVEQERTIKEAELETDLSIQRKRQEIEEARLENERTLLREQAEIEKERLEAKVNAEAKRKELVALSAENQRIQSDADAYAIEATMRAYRELPVENLKAMALAKMDSQQLMAMAFETLALNSGKIGELNITPDLFSQFMKKRG

SEQ ID NO: 6371 - protein, 243 aa, Proteus mirabilis
RFSTINYSMNSYQITSIGHIISPYKEKFAVPRQPGLVQDGVGQLILHTPYNHPDAVRGLEQFSHLWLLFIFHQTAQQGWHPLVRPPRLGGNSKLGVFATRSTFRPNAIGMSLVELKDIIIEKQSVILQLGSLDLIDGTPIIDIKPYLPYAESIAGATAGFAQYAPHEEMEILFSEDATQQLQYYSHQYPHLMRFITQVLQQDPRPAYKKSEQSDRVYAVHLLDFNIRWQVNGQQTLVLSIEPR

SEQ ID NO: 6372 - protein, 555 aa, Proteus mirabilis
QQLTYFFSVSFKQIETDDKSYLKNRRIFMSIRFSWRKSFIALSCLAALSVPVTTSAQTLKLAIGEEPTEGFDPMLGWSHGSYLLLHSPLLKQNADLTWYSNMLSDYQPSAEGTTWKLTLKPDLKFSDGSPLTAKDVAFTYNNAAASGGKVDMGNFLSATADDDLHVTIALKAPQSTFVNVLGSLGIVSADKYDEKTYAQKPIGAGPYRMVSFQPGQQLIVEANPYYAGKKNDFEKLIFVFLDEDAAFAAAQSGQLGVVRIPPATAAIAKNLPNVKLWERASVENRGIVFPMVKSGEKNAQGYDIGNDITADIAIRKAINYALNRQLLAEQVLDGYAVPAYTGVKGLPWDQTEAAFKDGDIEKAKQILDDAGWKLNKNGIREKDGLEAKLTLWYTSGDATRRDLAESIRALVQPLGIQMDLKSGSWDTVERYMHSNPTLFGWGSLDPMELYHHYSMNAAGVGYYNPGYYKNPAVEKHLQAALDAPTWQQAVPHWQAVEWDGKNGVGIKGDAAWAWLMNIQHTYLTDPCVDLGTGAPEIHGSWSLLNSVDTWKWTCQ

SEQ ID NO: 6373 - protein, 382 aa, Proteus mirabilis
MTLTPGGNISVPDQTLMVRIHSGSPVDVSAFRLYASGKVNGDADMVFYGQTTNDDRTIIYATAGNSTSFTVDLTRLRPDVDRIAFTATCEGQQTIAHLQHLSIQVDANNNVVANGHVDINGRTEAALILGELYRRNGSWKFRFIAQGFNGGLKPLAEYFGVDIADPEPAPAPAPAPSSVKLSKVSLTKEKPAISLTKKDDFGKIRINLDWHRESKSGGSGLLGGLFGGNKGIDLDIGAFVELQDGYKSVIQALGNGFGDFNRMPYVELQGDDRTGDVAGGEWIFINGREWKNIKQVLIFTFIYEGVPNWSKTDGVVTIHVPEQPPIETRLTDGNNGRAMCAIARLINENGSIKVERLNEFFKGHRDMDNAYGWGFRWTAGSK

SEQ ID NO: 6374 - protein, 438 aa, Proteus mirabilis
VYSTQNQGYVMRIKIIFSLILLFSWLFITPAKSDEQPLVILTTLSDTPMRPLTEAFSARYPETKVQVVYRRVAIATRMMKQYPTQPVDIVMSSSANFFHHLDREGLLARLPINYETPKWLTRHSDILNDKITTVGYSGIGIMSNRQYLQKLGIPAPKSWIDLSDPIYQGHLTMTTPANSGTMQLMVENVLQEYGWERGWQILLETSGNLSSISARSSRVSDAIARGIVGAGPIIDNYAFNHQKRFDFVDFSYFDKSIILPAYVAIVAESSKRDTAAKFIAFLLSDEGQEIIYKSDMAKIPLSKEILRNNDELANNTEFILNSNEAYRRSEVVNVLFDQMITHNFPLMRQVWNEIHEAEKQQNRSPERIAATNQARKIASSVLISEKEANSPTLQALFMKEADQREYSDQALAVLYQWRTLEAEKLEQALVLLKETKSP

SEQ ID NO: 6375 - protein, 319 aa, Proteus mirabilis
GLPTAKIGVSQQNMSKRLPPLNALRVFDSAARHLSFTKAAEELFVTQAAVSHQIKTLEEFLGLKLFRRRNRSLLLTEEGQSYYLDIKEIFSSINEATRKLLARSAKGALTVSLSPSFAIQWLVPRLSGFNQAYPGIDVRIQAVDREEDKLADDVDVAIFYGRGNWTGLRTDRLYAEYLIPVCAPSLLTGEKPLKTPSDLIYHTLLHDTSRRDWQAYVRQLEIQNQINVQQGPIFSHSSMVIQAAVHGQGVALVNNVMARSEIESGRLVRPFQDVLVSKNAFYLVCQDSQAELGKIAAFRQWILSQAANEQEKLGLLATS

SEQ ID NO: 6376 - protein, 352 aa, Proteus mirabilis
YKTTLQCEPMAIHRRQFLSYLATLAALSALPRCARAAITSRIAAQFGVLPTPENIHRVISAGPPTDQLLLALVPEKLLGFSSLNLGKSSLFADKLRKLPHLGRLSGRGSTLSLETLMALEPDIIIDSGNVDETYRSLAKRVSAQTDVPYVLIDGSLKDSPTQLRQTGALLGVAEKAETLALIAEQYLSDATLFASTLKIRPRFYLARGAKGLQTGSTGSIHTEAIELLGFENVADIAGFTGLTDVSPEQLLMWNPEVIITQDENAYQQIRQDSIWKNIQAVKNNKVLLFKGLPFGWLDGPPGINRLMGMRRLQSHFDHRIAEQATQDLQNYFACFYHTSLSAEQCQLLMRSS

SEQ ID NO: 6377 - protein, 306 aa, Proteus mirabilis
NEQTPWLLINNSHDYFCYLGCYRIMQNSLSDSYLQRFSGIGRLYGQQALYYFSQAHICVVGIGGVGSWAAEALARSGIGAITLIDMDDVCVTNTNRQIHALKEHVGQPKCEVMKQRILQINPECKVTCIDDFVTVDNVAEMMQNSFDYVIDAIDSVRPKAALLAYCRRYKIPVITTGGAGGQIDPTQIQVVDLAKTIQDPLAAKLRERLKSDFNVVKNSKGKLGIDCVFSTEQLVYPQGDGTVCAAKSTADGVKRMDCSAGFGAVTMVTASFGFIAVSHVLKKMLAKAQRTRHTSSCSVVDRIHSH

SEQ ID NO: 6378 - protein, 240 aa, Proteus mirabilis
LCETLEFTMLQKISANKIALIKRMQLSTPTLVDILDSLGKTIVLNSQLKSINLENFYSVGQAYTVQWKLIRKQKSILNKQPSTWEQVSSFLVPEITDAKGLFYIAGGHELITEAALAGGMSCTYFEKLGFEGVILGGAVRDKKDLTNLTIPVIATNLTPTDTQGAYFVSETGTQCTIEHATICSGDLVISDPNGTVIIPFSLVDNVLEEAIKIDSIENNMLEKIKHGQRLPELINITGRI

SEQ ID NO: 6379 - protein, 786 aa, Proteus mirabilis
EIMTIHTEQGFILTRHWSDTPQGIAVSYWLATENGPRKVTVAKQYAIGFVAQQNESILRSVVGHNRDIDIRPLALKDFERQPVLGVYCKQYRQLTQLEQQLKQYNIRLYEADIRPHERYMMERFITAPVWFRYQNSHTVTLKPASDYRPTLRTVSLDIETSEFGELYSIGLAGCGDNVVFMLSDTLPEVQESQQPEGYRLCYVSSRLQLLEKLNAWIQEYDPDAIIGWNLIQFDLRILHTHAQRYGINLLLGRQNTPLEWREHGFKAGHFFASAQGRLIIDGIDALKMATWNFPSFSLESVAQTLLGEGKAIDTPYARMDEINRRFKEDKPALAYYNWQDCVLVNRIFDTTHLMEFLLERASVTGLAADRSGGSVAAFTHLYLPSMHRLGYVAPNQGEKPEEHSPGGFVMDSTPGLYDSVVVLDYKSLYPSIIRTFLIDPVGMIEGMHHPDSTHAVPGFRQAWFSREKHCLPTIVSQIWHERDNAKRHNNAPLSQALKIIMNAFYGVLGSVGCRFFDPRLASSITLRGHEIMKKTRELIESKGYQVIYGDTDSTFVWLKAAHNEVQAEQIGRQLAQDVNQWWKSYLTETYQLDSQLELEYETHYRRFLMPTIRGMETGSKKRYAGLSHDKMVFKGLETVRTDWTPLAQAFQKELYTRIFNQQPYQQFIRDYVADTLLGKYDDRLVYRKRLRRKLSDYQHHIPPHVKAARLADDYNQLQNRPQQYQQGGWISYIITHLGPEPLEHITSTPDYEHYINKQLMPIADAILPFLQDDFSTLLNGQMTLSF

SEQ ID NO: 6380 - protein, 258 aa, Proteus mirabilis
LAMTNPVILADLDDTLFQTRRKMVDELALAPYKTGALDRSLAPRSFMTQEQAMLVDWMLEHADLIPVTARGTEEMSRVTIPFHSWAITTHGAVILTPEKVADEQWQHHITQSLTPYKQPLLRLQQSITQLMAERNIDGWARINYEYDDLPIYLVMKHNDSARLDELYAIGDEIEKIFSTKGFYIHRNSNNIAWLPEPIEKGKAVTYLLNKLKAERGVFPVIGFGDSLSDHRFMKLCNWYAIPRQSQFANAINTKIFGE

SEQ ID NO: 6381 - protein, 129 aa, Proteus mirabilis
SPQTSPKESVVLLVYKKPPPISPSVGKPANNQATPSLSFRLKRSLMTLSGSSMISFTPTATFSAATRFVMPNCSAKSEFTPSAKITALASNTSPSASTPTILPSRSTNLSTRMPVIHWAPASSACAISH

SEQ ID NO: 6382 - protein, 276 aa, Proteus mirabilis
RNFARLMIYDPNKPLFRLLFVSIVLVGLVIYGLSVSHTDIVMDFLARNQAPSTQYWFGTDNLGRSLWLRCFQGMLSSLNIGVTSAVVSGAIALIFAGISSINRHCDLLVRGVVDALLALPHLLLLILICFTLGGGQQGVIWAVALTHWPKLALILRGEIQRIREADYVMLSRRIGNTPFECVKKHYIPMLLPQWIVGTLLMFPHAVLHSAALSFLGFGQAAHEPSLGLLLADALRYLSTGAWWMVFFPGLILMCLVLIFDQFAKAMQQLWLRGAGC

SEQ ID NO: 6383 - protein, 151 aa, Proteus mirabilis
WFYLVLSTCYFQFIGNNEKNGKRFVSLVRLVHRLINCHIQNVFVDVVVIQALVVIRVRLIHQVHQVHPALLVLLVLLAVAAVVRVVVGVLQGVGRGICRYFYLMMQSPERNLHVVKRLLGHASITSILEYIDESVDNLRDILEAELMGREY

SEQ ID NO: 6384 - protein, 318 aa, Proteus mirabilis
PGIAIYWLGGLNRPPLHICYENIYGSPIEKSRKKQMSGITAALVKELRERTGAGMMECKKALVEANGDIELAIDNMRKSGQAKAAKKAGRVAAEGIILAEVAADGKFGALVELNCETDFVAKDAGFIAFGKDVMAAVLADKTDDIEALKAKFEDARTALVAKIGENINIRRVAILEGEELGTYLHGARIGVLVAAKGANEELIKHIAMHVAASKPEYVRPEDVPADVVEHEHQIQMDIAMQSGKPREIAEKMVTGRMNKFTGEISLTGQHFVMDPSKTVGDLLKENNAEIINFVRFEVGEGIEKVEADFAAEVAAMSK

SEQ ID NO: 6385 - protein, 222 aa, Proteus mirabilis
KRHAHLVNLRERFMNLFFQNSLAFPSIIFSVLLIIILFYWLCAAFGLLDIDLFNIDSELDVDATGLAGWLTKLGLAGIPVTIILTFFTLFGWFISYFCVHWFIRFIETDLLRYVIGFIAFIIISFVSLNLTALCLKPIRNKLISRSKPKSVHQLVGKFAVVRSEYVTENKGEALLEDGGAGLILQIRAPATENIKRGDSVIIISYDAPTHSYQVVTEDEFHR

SEQ ID NO: 6386 - protein, 977 aa, Proteus mirabilis
IIYLRAEFIYMPFTLGQRWISDTESELGLGTVVAIDARMVTLLFPACGENRLYSRHDAPITRVMFNVGDTVTSHEGWKLAIDNVVEDNGLLIYHGVRLDTEEPAQLREVFLDNKLTFNKPQDRLFAGQIDRMDRFALRYRARKFMSEQFKQAQSGLRGIRASLIPHQLYIANEVGKRHNPRVLLADEVGLGKTIEAGMIIHQQIMDGRAERVLIIVPESLQHQWLVEMLRRFNLRFSLFDDSRYSESLLDSDNPFETEQMIICSLDFVRKNKQRFEHLVEATWDMLVVDEAHHLVWSEKAPSREYQVIETLAEAIPSVLLLTATPEQLGQESHFARLRLLDPNRFHDYNEFINEQQKYRPVADAVTILLSEDDLNNEQQNSISEMISEQDIEPLLKASNTQGEERTKSCQALIHMLMDRHGTGRLLFRNTRSGVKGFPNRLLHAIKMPLPTQYQTAIKVAEIMAAKKSLEVRAKEMLYPERIYQEFEGENATWWNFDPRVEWLLGFLTANRHEKVLVICAQAATALQLEQVLREREGIRAAVFHEGMSLLERDRAAAYFASEEEGAQVLLCSEIGSEGRNFQFANQLVMFDLPFNPDLLEQRIGRLDRIGQNRDIDISVPYLEGTAQSVLLRWYHEGLDAFEHTCPTGRTIYDNEYDALVNYLAQPNELGDFDKFIVSCRKQHDEMKLKLEQGRDRLLEMHSNGGEVGVELANKIAEQDNDPDLVNFALNLFDIVGINQEDRSDSLIVLTPSDHMLVPDFPGLPQDGCTITFDREHALSREDTQFISWEHPIIRNGLDLVLSGDTGSCAVSLLKNKALPVGTLLVELIYVVEAQAPKHLHLTRFLPATPVRLLLDLKGNNLASQVEFESFNRQLNAVNRHTSSKLVNAVQNEVHHVLKASESLMEAEAKTLIEQAKQEADNALTHELSRLEALRAVNPNIRDDEVEAIENERTHILNHLDEATWRLDAIRLIVVTHQ

SEQ ID NO: 6387 - protein, 196 aa, Proteus mirabilis
GIYFSFLCLQTMITMNDISTELKQLTQNYVDLWQQESGFPPASHELYGVPSPCISRTGDNVVYWLPQPFTGRDKLEKVEKAMGIIIRPELHDYFTTQYAGDMQVRFDSLNFTLLQIWSEEDFIRLQENMIGHLVTQKRLKLTPTLFIGTTASENDIISVCNLSGEVILETFGQKKREVLADNLSLFLTKLTPVFDK

SEQ ID NO: 6388 - protein, 677 aa, Proteus mirabilis
HRSASNMEPLQLLMWSIILYVVGGVIALFLKKQEGLAILISGISAIIGGVLGVLSALPVILNGETISFAMAGPFDFAAFVVRMDMLGAFMVFVISLLVTVCALYSLSYVQEYKGRGAWSMGFFMNLFIASMVGLIVMDNAFYFIILFEMMSLASWFLVIADQDDESIHAGLLYFFIAHAGSVLIMIAFFLMWRESGSLDFDSFRQLSLSPAMASVVFLLGFFGFGAKAGMLPLHSWLPKAHPAAPSHASALMSGVMVKIGIFGIIKVGIDLLGASQMWWGIVVLAFGAVSSVLGVMYALAEHDLKRLLAWHTVENIGIILMGVGVGMVGMATDHPVIAALGLLGALYHLLNHAVFKGLLFLGAGAIINQIHTRDMDKMGGLAKLMPYTATAFLIGCMAISALPPLNGFVSEWYTYQSLFTMSYDGNFVMRLSGPIAIIMLAITGALAAMCFVKVYGVSFCGGPRSEQATKAKEVPLPMTIAMGLLALFCVVLGVGAAFVAPIIANIAMSLSETSALTVTQGAILVPDSASQAMFSPALTFILLIALPLIPFLIYLGLKGGQPAFRRKGNPWACGYVWEKDMAVSAGGFTQALRSMFAPLYRMRKQLDPSPWLSRGFNKTQRGAEKVEPFWDESIIYPLVRGIQRFAKRIQCLQGGDFRLYCLYVVAALVILLLVIAA

SEQ ID NO: 6389 - protein, 267 aa, Proteus mirabilis
MTYLLISGDVMKIITCYKSVPDEQDIVVNNADGSLDFSRANNKISQYDLNAIEAANQLKTQLDGIQITAMSVGGNALTNAKARKDVLSRGADDLVVVVDEQLEASLPYQTATVLAAAATKQGYDLILCGDGSADLSSQQVSLLVGEILNIPAINGVNKIVSITTDSITVERELENEIETLTITLPAVIAVSTDINSPQIPSMKAILGAAKKPVQQWSVADLGLEPITPRSEQTVLAPKQKVRQRIIIEGDGDDQIAEFAEYLRKIIK

SEQ ID NO: 6390 - protein, 259 aa, Proteus mirabilis
PILAFILNVLLFMDLTNMTMKRTKSINRDAFRKAFRPYRLAPVAIAITAVFALSGCEESDETVSLYMNAQECAQANPSQAAQCEDSYRTALQEAQRTAPKYATMEDCVAEFGDAQCTQTASIDGNPVNTENANNLNPDSSQMAQANSGGSFFMPLMAGYMMGRLMGGGAPAQPLFSSRNPSSPANGKFVDATGRNYGPAVGGRQMNVPKTAMTPKPSTTSTITRGGFGNTVSRQAAAQRASATNNNRSSTGSSSYRAGG

SEQ ID NO: 6391 - protein, 341 aa, Proteus mirabilis
AMPAVDEVFMSQSARITLLLLLFSVAVVIAITSGKYSLTVNELWTVVSSKLTGHIEESRTATVFWQIRLPRVLAAILIGGGLAIAGAAYQGMFRNPLVSPDILGVSSGAGVGAVLGIFLGHSMLSIQLFAFVGGLITVALVYFIAKLAKQQDPVLSLVLVGIAISALCGSAISLMKILADPYTQLPSITFWLLGGLSTITAPDLLSVAPLMLLGFIPLILLRWRMNILSLSDEEARSLGLNVEITRLIFILSATLITASAVSIAGIIGWLGLIVPHIARLLVGANFGYQLPISLLVGATMLLITDTLARTIANIELPLGILTSAIGAPFFLMLLLKTRRDR

SEQ ID NO: 6392 - protein, 278 aa, Proteus mirabilis
SHAATMVKRGRMLSFEQLSIDIAQFRWLGKRTWQPLLKSISLDIKPGKMLALVGGSGEGKSLLLQSALGLLPANMRTRGTIKLNGHPLTERELIAYRGNTFCYIPQGVTALNPLISIGEQLGRSARLSGADITYEDIKHQFGLYHLSSSLVKTYPAKLSGGMAKRVLACNATLSNAQYILADEITSWLDDEHACLLLEHLKELCHQGKSVLWVTHDLALAARYADTIAVLRQGELNEIVAAKALYHHGGSEWLKTLWNALPEQQFLDLQEGACNPYPY

SEQ ID NO: 6393 - protein, 344 aa, Proteus mirabilis
PKMAHIVTHNHTTREVWLTQLAQAISDPVELLQLLALEHHAELQRGAQARRLFPLRVPREFVARMKKGDPNDPLLLQVLTAHAEFTLTPGFSTDPLDEQQNAVPGLLHKYQNRALLLVKGGCAVNCRYCFRRHFPYEDNKGNKANWQKAIEYIKNNPKLDEIIFSGGDPLMAKDDELDWLITQLEAIPHIKRLRIHSRLPVVIPARITHTLCQRLQQSRLQNIMVLHINHANEIDDALREACLKLKNAHVTLLNQGVLLRGVNDNAQTLADLSRALFDAGIMPYYLHVLDKVQGAAHFMVPDSEAREIMKSLMSLVSGYMVPKLTREIGGEPSKTLLDLGLRQV

SEQ ID NO: 6394 - protein, 92 aa, Proteus mirabilis
QMVALMAKSTRISSVSSWTSRISLWEMLAVASLFTVITHSIAGTAAFTLVLVISMLLSTIMLFHKKLQMWVMIPAGVVITYSLMTFFLTYHG

SEQ ID NO: 6395 - protein, 114 aa, Proteus mirabilis
LKKAVFDNKYLINHERKEDSMLINMVSVLLFFNISFVAIIGYSQALKVDFQRLVAIQQAGASLFAFYGQMSFNSVDNLKIMTQSLIEAEGCQKIEGSITHHSGYVTRLYHWSCD

SEQ ID NO: 6396 - protein, 141 aa, Proteus mirabilis
TKEAFMSDDAKVYFWSLRQKFVDSDDDIPEQAQQVMYYSLAIGHHVGMIDCLKTELVCPLEKYQAWIDLLPEGEAKRKMQGLLTFGEININSEHTHMLALAFDPIAKSDDPLFSEWSQTLINLLGEIVIEPAIYLIVKRKP

SEQ ID NO: 6397 - protein, 389 aa, Proteus mirabilis
SSLYEIMQLVCYSPPKPIRECDQHKNFWRINMMDHQPFSGSYLLGDVDFLLQPVKIEMTPVELKEELIQSGKRHYSDMLSQEPEPTTWHLELFEKALAAGATRLATQVIMLAKSLIAHFGDTPIILTSLVRAGVPLGVMLQQTLRKMGKTSYHYGISIIRDRGIDNEALSWIEQRHGTEGIVFVDGWTGKGAITNELIRSLAGREGFPAQPHLVVLADPCGCAWLSASDEDWLIPFGIMGAPVSGLISRSIWTEQGFHGFVDCQHLKQYECSRYLVDKVGKIVDALIDNDIPLATFKHQPSDLKKLSENVVSLLANKYDISNINRIKPGIAEATRAVLRRVPEHILVKEIADPDVALLIYLAKQKNITVTEAGKALGQYRAVTIIKKVQ

SEQ ID NO: 6398 - protein, 166 aa, Proteus mirabilis
LSIYLGGDMEQKIIVMGADPSGYELKNAVKSHLQAKNYTIKDITESGPIGYCDVGDKVGAIISEHPEYIGFVFCGTGMGVSISANKHKNVYCGVCESVTTARFCKVINNCNMLAMGGLLITPFKANMMVDAYLSATFTQGFSEATPDDLQCGLQTMKEVEKRIYTD

SEQ ID NO: 6399 - protein, 239 aa, Proteus mirabilis
RATYFVGCTRCYTCDDKISFPITITKDQKMVLTHHQIILWLQQCAQLFEQNSDYLTDLDREIGDADHGLNMNRGFKKVAEKLPEFADKDIGFILKNTGMTLLSNIGGASGPLFGTFFIRAAKPTASLQSLDVNQLYEMTKEGVDGIVSRGKAQPNDKTMCDVWWPVVDSLKHANDQSLSIEDAIDNALKVAEKAAEETIPMQAKKGRASYLGERSIGHKDPGSASVVLILQALSNAIHA

SEQ ID NO: 6400 - protein, 269 aa, Proteus mirabilis
GKYYIIIKNCNYYFIRVGMYFFLGFLLFLIVLMVICRIRVLWLARKNTITEKNFKTFKEYNNIEDYEKEAKQAVYAATISKTLFEECQCLITLRTMLESLHTDYEKYEKVNPLLMELLRKKFTFTYSAFITIYPEPIEESGLERFSLINTKKYCPEHVWKHILKSAIYTNEELDDYFGSQELLPLERMCTDMDLYNEFKGTVLFDEVIGCYVNEENEGSQIFDNEVYSVTEEQLRQWLDEELAFLSYVTEGLLNICIEYIRKENGIIRV

SEQ ID NO: 6401 - protein, 197 aa, Proteus mirabilis
FLDYFIREVNMKFNKLGVMVAGALLMGSLSTQVMAAKNADVTFSARLVAATCDISASQDRVDLGTYATTDIQNINQAVSEKDFNLVLNNCTKIGKPAEGEDPAVTVSNIELLASGNGLVGNEQLFASAGATQAGIKLTAMNSVVLKPNESTELQNLKAEGEGNLIIPMKAGLFATETGDSLKAQDINVPVTFSVAYN

SEQ ID NO: 6402 - protein, 198 aa, Proteus mirabilis
GYLLINLLKYSDIERSLFPPTSLFRIFRILDYFSNISDNLVIKRGEILMNTISERLSAEDIALAKLSSQELSAVMDINGKTQKLSIIDKTGNNHIVQIPNSALRLMIEILTQLGQGNTVSITPIHAELTTQEAADILNMSRPTFVKLLDTRAIPYSRKGNRRKVAYADIVAYKNELEQKRLDALAELSQLDQEMDMGY

SEQ ID NO: 6403 - protein, 307 aa, Proteus mirabilis
KSHYHKHWLLLVSFPLVILVLLPYLEMKLLEHYLFTSISKSVLITHKMALSPRCSFCCYVSRFLALSNAFQENPMIKLEQLSYTYEHQHLTFNLTVKAGERIAILGPSGAGKSSLLSLIAGFLPSESGSLFLKGKDHTKTAPAQRPISMLFQDNNLFPHLTVRQNIGLGLDPGLKLTVAQKALLESRAKQVSLSDYLERLPSQLSGGQRQRVAIARCLVREQPILLLDEPFSALDPALRIEMLTLLEQICDEKNLTLLMVSHSLEDAHKIAPRALVIDNGTIVYDGNTASLIKGEVDQSLLLGIPFN

SEQ ID NO: 6404 - protein, 476 aa, Proteus mirabilis
SMLYRDQLHFSLLFREKKESYVITHVSPLGSMDLLSQLEVDMLKRTASSDLYQLFRNCSLAVLNSGSLTDSSKELLSKYQDFDINVLRRERGVKLELVNPPEDAFVDGKIIRSLQANLFAVLRDILFVHGQITTAKRDLHLNLENSAHITNTIFSILRNARALHIDEDPNMIVCWGGHSINETEYLYGRKVGNELGLRELNICTGCGPGAMEAPMKGAAVGHAQQRYRNSRFIGVTEPSIIAAEPPNPLVNELIIMPDIEKRLEAFVRIAHGIIIFPGGVGTAEELLYLLGILMSPENQEQVLPLILTGPKESADYFRVLDDFIVNTLGEDARRHYQIIVDDAAEVARIMKKYMPLVKDNRRSTGDAYSFNWSIKINADLQHPFEPTHENMASLNLSTHQSPEKLAADLRRAFSGIVAGNVKEVGMKAIEAHGPYKIHGESDIMRRMDILLAGFVEQHRMKLPGGSAYQPCYEIIS

SEQ ID NO: 6405 - protein, 316 aa, Proteus mirabilis
SIDLLKGNRMSQLETELKLSAIPAAIPQIIQRILTLPYQHTPPHKLTNLYFETSDNQMRNWDMGLRIRGIDSHYEMTIKTAGKVVAGLHQRPEYNVTLNEPTLDLTRFPAEIWPDKTDLTALQAQLKVLFHTDFHREIWLVDYLESQIEVVLDKGTIRTAQYELPIEEFELELKKGQVADVIALATFLGEQGGLRLASRSKAARGYYLAKDKPALSLSVVNLAPNDTIAEQLTKWLAAIQALEEAIFANPTPPTLTMPAMLALFSDWCKKQPQLPESMQQALDNLSLLSFTRATDYYHVLWLNFKLSAMAWLLAIA

SEQ ID NO: 6406 - protein, 225 aa, Proteus mirabilis
KISLSVIDCQEYFIMRTQMAKLDKEQVIDNALILLNEVGMEGLTTRKLAQKLGVEQPTLYWHVKNKRALLDALAETILQKHHHHVLPLANESWQDFLRNNAKSFRQALLMYRDGGKIHAGTRPSANQFETSEQQLQFLCDAGFTLTQAVYALSSIAHFTLGSVLETQEHQESQKEREKVPKTEINYPPLLTQAIDIMDSDNGEAAFLFVLDVMISGLETVLNNHH

SEQ ID NO: 6407 - protein, 967 aa, Proteus mirabilis
GSSYQMRKYLSQLWIMLLLMLVSINSFATDPLWQVLPDSIEKSESDPRDYQAIKLANDMTVLLVSDKKAVKSLTAVALPVGALEDPDSQQGLAHYLEHMVLMGSTKYPKSGDLTEFLNKNGGSHNASTTTYRTAFYLEVENSAINEAVDRLADALAEPLLDPKYADRERNAVNAELTMARSRDGMRFWQVRAETLNPAHPSSRFMGGNLETLSDKPESKLQDELVKFYQTYYSGNLMNGVIYSNKSLDELAKLAADTFSRIPNKNTQAPVTTVPAMTEKEKGIMIHLVPAQPQKTLQIEFGIDNNLADFRSKSDEYIGYLISNRSTGTLATWLQEQGLAENISASSESYIDRNQGSFTIYVSLTDKGLAEKDKVISAIFSYIQLIQNKGVSERYFKEIANVLDLSFRYGSIVRDMNYIEDISDMMLRYPIKNILNADFIADDYQPSAILSRLESLTPENARIWVISPNEPSNKQAYFVHAPYQVDKITAKQLASWQELASDISLSLPTLNPYIPDNLSLIDADSNITKPQLLWQDSHARLFYMPSHYFSDEPKASVTLSLVNKNADRTVKQQVIQTLTNYLADLTSSELAYQASVAGMNISSSSGRGVDFSVNGYTQHLPELVNATLKSYITFEATQQELDQAKSWYREQLEVTHNLKAYDAAMLPARRLNTIPYYEEADKLKALESITLQDIKDNRRDVIENAALQALIIGNLTPEQSREIVKSAQALLGNTGTEYWIGDTLVFDKLNQVTFQNKSKSTDNALGELFIPVGYERLQGKAITSVLSSIVHPWFFEQLRTEEQLGYAVFAFQASMGEQSGLGFLLQSNAKPPVYLNERYHAFYQQAYDRLKKLSEAEFNQYKKAIIDEVKQPPQTFYEEVSLYRNDFYRNNLKYDGREKFLAQLNKVTLKQAIEFYEKAIIKPTGLVFVSQIIGKEGNNADYAQNKQWKIYSTVSELQKTLPVEEIKE

SEQ ID NO: 6408 - protein, 214 aa, Proteus mirabilis
PEEYCMNKKENTPFLYTRNDVELISKKTRYKGFFRMNEYRFKHRLFKGGWSAEVKREVFERGHAGVLLAYDPKRDEVVLIEQIRIPAYETSQTPWLLEVIAGMVEEGESPEEVVRREATEEAGITIGRCKPIVSYLSSPGGTSERMYVYVGEVDATTATGIHGLACENEDIRVHVVSREQAYQWVEEGIIDNAASVIALQWLQLHHVTLRKDWL

SEQ ID NO: 6409 - protein, 183 aa, Proteus mirabilis
KRHLISDKKFILGFKESIVKKLLCAAALGMALTMSAGAQAADKVGVVNIGQVLQKVPNRDAVEKQLENEFKSRDTELQNLGKALQTAVEKYQKDAPTMNATQRANTEKDLVAKREAYAQKAQAFEQDFSRRQAEERNKIMKRVLDAVDAVAKKEGYDVILDANTVPYFADGKDITAQVQKQVK

SEQ ID NO: 6410 - protein, 491 aa, Proteus mirabilis
GNNLLELFLYKINRGNSAKLLQQGIKMKKLLSLLVTMSLTGFSTASQAEDLLQVYQKAKDSNPELRKSLAERNQAFEKINEARSPLLPQLGLGASIDYKSGYRDAKNTESNSLGANLTLTQTIFDMSLWRQLTMQEKTAGMSDVTYQTSQQQLILDTATAYFNVLRAIDSLSFIEAQKEQVYRQLDQTTQRFNVGLVAITDVQNARANYDSVLAQEVAGRNELDNALEKLRQVSGVYYINLASLNIARFSTTPPDAIDKLLKDAEERNLSLLSARLGQDLARENIRLAQSGHLPTVNLNASTGVSNSHNHGSALPPETPANSRNSYNGQSSIGLSLSIPLYTGGRTSSQVEQAQYGFTSASEQLESVYRSIVQIARSSYNNISASISSIKAYQQVVVSAQSSLDATEAGYQVGTRTIVDVLNATTTLYDAKQKLSSARYDYLINQLNIQYARGTLNENDLIQLNNALGEEISTSPDNIIRPLTSPVLNTTN

SEQ ID NO: 6411 - protein, 103 aa, Proteus mirabilis
FVFQPLIAGQGNTKLQVWTGAMYQDITQRFKGNINNLNLPPAFAGMIALMNDPDMKFDVEQHLAHKWNQTVGARLEVTRNFNVITEVGFNNRNSFFVSGEFRF

SEQ ID NO: 6412 - protein, 172 aa, Proteus mirabilis
EALHYINYILMPMQNAIFGNKSINMKTISPLNPADLPLAWEIEKLSHSFPWSEETFYSNQGDHYFNLKICIDNIMVGFAITQLILDEATLFNIAIHPDYQGKGYGKALLLELIDNIERKDIATLWLEVRESNQKASNLYESIGFNSVSVRKNYYPTATGKEDAIIMAYPIKF

SEQ ID NO: 6413 - protein, 72 aa, Proteus mirabilis
NSPQSNLETISLLILIKNNLTLIDIRARYVSHELAYQCTQPLFVTDIYKLVHSFCYLVAQSYRQCYLHLYQH

SEQ ID NO: 6414 - protein, 123 aa, Proteus mirabilis
TDTQRNEGIMRIKLLLGATAALLLAGCSATNTLTSAGSQVQITDTQPGSECQLLGTVTGVQNNWLSGSRTESQSLRGAANDLRNKAAAMGGNVIFNVGTGAGSIVDSFAPLDSKMSGQVYKCQ

SEQ ID NO: 6415 - protein, 390 aa, Proteus mirabilis
RQHHQWLPSGVWPASTYTRVTIESSRPLKYRQFALSAPDRIVVDLEGIQLNSVLKGMASQVQTNDPYLKLIRVGQNTPTTVRLVFEIKTPVQPQMFTLKPVAEFKNRLVLDFYPSHAATSEDDPLLALLREYNEGDLQQAVPEQTDTRKPGRAGRDRPIIIMIDPGHGGEDPGAMGKYKTREKDVVLQIARRLRALIDKDAKMKAYMTRNEDVFIPLKVRVAKARKMQADLFVSIHADAFTNRSARGSSVFALSKTGATSNTARYLAQTQNEADLIGGVSRSGDRYVDHAMLDLVQTATINDSLKFGSEVLKLLGGVNKLHKNKVDQAGFAVLKAPEIPSILVETAFISNIEEERKLKTAKFQQQVAESIFKGIKAYFANGGELTLADRG

SEQ ID NO: 6416 - protein, 1129 aa, Proteus mirabilis
NEDLMFHIYHSNQLSLLKSLMVHFMQNRPLSSPFEQEVILVQSPGMSQWLQIQLAESLGIAANIRYPLPATFIWEMFTRVLSGIPKESAFSKDAMTWKLMALLPNYLDDPAFKPLLHYLKDDEDKRKLHQLAGRVADLFDQYLVYRPDWLSAWENDQLIDGLSDNQYWQKTLWLALQRYTEDLAQPKWHRANLYQQFISTLNDAPVGALAHCFPSRIFICGISALPQVYLQALQAIGRHTEIYLLFTNPCRYYWGDIQDPKFLARLNSRKPRHYQQLHELPWFKDEQNASTLFNEEGEQNVGNPLLASWGKLGKDNLYFLSELEYSDVLDAFVDIPRDNLLHQLQADILDLEDFSQIGQTLEDYQSSEKKRIIANDDRSLTFHASHSPQREVEVLQDQLLHLLEQDADLLPRDIIVMVADIDSYTPYIQAVFGNAPAERYIPFAISDRKARQVHPVLQAFITLLELPQSRFTAEQVLALLEVPALAAHFAIFENELKLLRRWVEESGIRWGLDDENVASFLLPVTGKNTWEFGLLRMLLGYAMDSEAGPWQGVLPYDESSGLVAELAGHLADFLYTLSEWRTRLSETRNLEEWLDIGQQLVDAFFDTDEETELVLALITQQWQKVIKNGLEAHYQHEIPLVLIRDELTVRFDDEKISQRFLAGSLNFCTLMPMRSIPFKAVCLLGMNDGIYPRNIQPLGFDLMAEKRRRGDRKRRDDDRYLFLEALSSAEKYLYISYIGKSIRDDRECNPSVLIKELQDYIGQNFRLREDASLNVDDSAQRIISHLLTQHSRVPFAPENFKTDALYRSYAAEWLPAASGKGTAHQAFSTPLNKKIEKVSLDELSRFYRHPVRAFFQQSLKTNFVIEETELPEEEPFVINALQRYLLNQWLLKALIEGTSTEALYERIKAAGKLPASAFGQIYWEQQIETLQPLAEKVRSERLATHSVTIEYQFNTIPLIGRLNEVQADGLLRWRPATLTANDLLQLWIEHLVYCLSGGTGESRFYGRKESQWCLSPVSADIAYSTLERLIQDYQTGMNTPLALFANSGWAWLQACFDKKTQTFLFDDEEIQNKAELVLTQYLTDSYNREGEMNDIYIQRVFHQLDAPFLEAVKQTTLAIFKPIIPFIKK

SEQ ID NO: 6417 - protein, 144 aa, Proteus mirabilis
LSSHLVNKKEKTMSLYLSSEMISYDMDLNRNEGEESKIQAKFIHGSNFTMAFWTFKTNAIIPEHKHEHETATSILKGSLKLTVNNRIVYLHAGDSFIIPSWAVHHAIALEPSEVIDVYTPVREDYVARQNGVIKTYLETSQPQG

SEQ ID NO: 6418 - protein, 410 aa, Proteus mirabilis
VFSQENNGESSVAKAAKRAFVCNECGADYPRWQGQCSACHAWNTITEVRLAATPSARNDRFSGFAGDAKGISRVQKLSEISLEALPRFSTGFKEFDRVLGGGVVPGSAILIGGNPGAGKSTLLLQTMCRLATEMKTLYVTGEESLQQVAMRAHRLGLPTTELNMLSETSIEQICLIAAQEQPKLMVIDSIQVMHMADIQSSPGSVAQVRETAAYLTRFAKTNDIAIIMVGHVTKDGTLAGPKVLEHCIDCSVMLDGETDSRFRTLRSHKNRFGAVNELGVFAMTEQGLREVSNPSAIFLSRGDEVTSGSSVMVVWEGTRPLLVEIQALVDHSMLSNPRRVAVGLEQNRLAILLAVLHRHGGLQMSDQDVFVNVVGGVKVTETSADLALLLSLVSSFRNRPLPRDLVSYFW

SEQ ID NO: 6419 - protein, 111 aa, Proteus mirabilis
KSIQPERAILARQFQTKVGYQVIFDIKTAENIAIPFGAMASLTDEKDKQVNTGIIDAYQSLYMSGLPNDGNVVVTWNNNTGKHSCQFSYSELEKIEVSQQNPIRMVTVNCQ

SEQ ID NO: 6420 - protein, 589 aa, Proteus mirabilis
SAIHQYRFRRSNVSYQNYVSRKEGNELGAGYVAKVREKFPSAILDEERQTADQLTITVKTGSLPEVVEYLYYGLGGWLPVLFGNDERSLNGDYAVYYALSMEEGEKCWIVVKAHVSPITLEFPSVTPRVPAAVWGEREIRDMYGLIPVGLPDERRLVLPDDWPEDMYPLRKDAMDYRQRPTPTTETETYPFVNEGKQDARVVPIGPMHITSDEPGHFRLFVDGENIVDADYRMFYVHRGMEKLAETRMGYNEVTFLSDRVCGICGFTHSVAYTTSVENALGIEVPRRAHTIRSILLEVERLHSHLLNIGLASHFTGFDTGFMQFFRIREKSMQIAEMLTGARKTYGLNLIGGIRRDILKDQRIKTIQLVREMRKEVTELVDILLSAPNMEQRTVGVGILDKKVARDFSPVGPMIRASGFKRDVRFDHPFADYGNLPLTLFSYEGGDVFSRVMVRIKEVLDSMAMIEYALDNLPEGPLLTEGFTYQPYKFALGFTEAPRGEDIHWSMLGDNQKLFRWRCRAATYANWPVLRYMLQGNTVSDAPLIIGSLDPCYSCTDRVTLVDVKKRKSKTVSYKEIERYSIERKNSPLK

SEQ ID NO: 6421 - protein, 172 aa, Proteus mirabilis
KENQVRWLPLIVICLLIYIEAVIFVHVASSIGVLTTLFLVVLTSCVGISLVKNQGVKNIASMQQKLAMGEVPAAEMVKSVSLVLAGILLLIPGFFTDFLGLLLLLPPLQALLVTKLITRIKIYTPGQGGNGFSSHQGGSTFEGEYQRKEDSPSKQLNNKDEHQDNDHFSDKK

SEQ ID NO: 6422 - protein, 160 aa, Proteus mirabilis
PLGLNWNLKACRRFILSIILWSMKNETNIRRGRHCVFLMHVHLVFVTKYRRKIFDQDAIEKLRGYFASVCADFDVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 6423 - protein, 156 aa, Proteus mirabilis
PLGLNWNLKACRRFILPIILWSMKNETNIRRGRHCVFLMHVHLVFVTKYRRKIFDQDARCYFASVCADFDVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 6424 - protein, 64 aa, Proteus mirabilis
VKKHPFCGCFILMSDISVTTAKKRQFCNLYHSWINSHLEPIFFKKRTSLTLSSSVSRQNYLYLA

SEQ ID NO: 6425 - protein, 827 aa, Proteus mirabilis
WDLHFSMISLAYNKISRDRLGKHKTTMAMKKLLIASLLLGSATAYGSDGFVVQDIQFEGLQRVAVGAALLNMPVRVGDSVSDDDISRTIRSLFATGNFDDVRVLRDGNVLIVQVKERPTIASITFSGNKAIKEDMLKQNLDASNIRIGETLDRTMLANIEKGLEDFYYSVGKYNATVKVVVTPLPRNRVDLKLVFAEGVSATIQQINIVGNKAFSTAELVNRFQLRDDVPWWNLAADEKYQKQKLAGDLETLRSFYLDRGYARFDIESTNVSLTPDKKGIYITINLKEGDKYTVESTEINGNTAGYTKEIEDLIQIAPGSLYNGAQVTKTENEIKNLLGRYGYAYPRVMTNPEINDENKTVKLHVNVDAGNRFYVRQIRFAGNDITKDSVLRREMRQMEGAWLGSDLVEQGKERLNRLGYFETVETETQRIPGSPDQVDIVYRVKERNTGSLNFGVGFGTESGVSFQVGVTQDNWLGTGNAVAINASKNDYSTYAELSVTDPYFTVNGVSLGGRIFYNDFRANDADLSGYTNKSYGLDGTLGFPINEYNSARLGLGYTHNGLSRMEPQVAMWRYLESMGENPGFDKRESFNADDYTVSLGWTFNNLNRGFFPTSGARSNLSGRITIPGSDNKYYKVTWDGMAYYPLDEKESWVTLFKGRLGYGDGLGGKELPFYENFYAGGSGTVRGFRSNNIGPKAIYLKKIAKDGRTIIDPSLSSDAVGGNAMAVASFELITPTPFIDDKYSSSVRTSMFVDAGTVWDTNWNSTNSNWTAGMPDFGKASNIRVSTGVALQWLSPLGPLVFSYAKPIKDYEGDKSEQFQFNIGRTW

SEQ ID NO: 6426 - protein, 157 aa, Proteus mirabilis
PNMQLSSRQIRVFKLAILLSTGKKVPTIKIISALECSEPTLTRVLKEIRESYSAEIKYSKSSRSYQMTERGQLDNKTLRRMREALSSNEELQHSGTTSRVYLDKDKKKSVSLSLKMSALRKIDKLSFLRSTTRSQTVEFLVDNYVEHLIQVALQDKK

SEQ ID NO: 6427 - protein, 499 aa, Proteus mirabilis
ISQQLFSYQLILTRGIGIWVFCCGESMSFSRRQFLQASGLAVCLGSLSSSVRAGAVSDRKLPIPPLLESRNGQPLFVTLQKVHWAFDGTQKTEVWGINGSMPGPTIKVKSGDDVKLIYSNRLNEPVSMTVSGLLVPGTQIGGAARMMSPGAYWSPVLPIRQKATTCWYHANTPFKMAPHVYNGLVGMWIVEDEESKSLPLPKHYGVNDFPIILQDKRLDNFGTPQYDKEAATEGFYGDTLLVNGCEDPYIEVSRGWIRLRLVNASNARRYELSANDGRSLYLIASDQGLLTSPVELKSIPMAPGERREILIDLSEGEEVTITAGQSAGFMDRLRGIFEPSNLLRNTNVLTIKPTGLMSLVTDKVPQQLVVDDTQITTSIQPRTIQLQNSPPGINNARWELSRIDLVGKQNGWERWLVTVETPQPFHIEGARFKVINHDGQKPAPADFGWKDTVWIEKQSELLVELKQPSYSHFPFVYYSQILENADKGIAGQMEITPSE

SEQ ID NO: 6428 - protein, 245 aa, Proteus mirabilis
LIWQHAHTCLRKRLNMLKDKLKFKLQKTAIILICIALLAFLMQGASYFSRANQHARITQFEELAKTLAEQVAFSLSNYMDDSSKDNVNPHIIANLNHLTHDSRVLDASLYWQDGTQIAHSGENVTVKERLALEGQKSGGSFNHQLVVPIPGQDQPKGFLRLTLDTHQLVTESGQVDNTTNLLRVMLLVALAIGFLLSHSLLQLTPVHWQQSPYLLTASLPTRHEKEDDEQKSDQQEETENRSEVK

SEQ ID NO: 6429 - protein, 371 aa, Proteus mirabilis
GHRHLAMNKVALYCRPGFEKECAAEITDKAGQIGVYGFSRVKEGSGYVIFECYQEGDADKIARDVDFRGLIFARQLFVCGELLKNLPPEDRITPIIDQLKGSTEKAGELRVEVADTNESKELLKFCRKFTVPLRNQLRKEKILLKVENYSRPVIHVFFIAPGCCYVGYSYSFNNSPFYMGIPRLKFPADAPSRSTLKLEEAFHVFIPYEEWEERLASGMSAVDLGACPGGWTYQLVKRSMMVHAVDNGPMAPSLMETGQVRHHQADGFKFEPTSKNITWLVCDMVEKPAKVAALMTTWIVNEWCREAIFNLKLPMKKRYEEVAHILDKIRAELAEKGINAKIQAKHLYHDREEITVHIQNIWAAYRPDREF

SEQ ID NO: 6430 - protein, 236 aa, Proteus mirabilis
GDRQMVNKIRFFQYISLCVLGVLFLSFQVQAGVGLSQTRIIINGDTNTASISARNNNAQPYLVSNFITEKLDTSSPPLSGMFVITPNIFRLAPESENTIKIQIIPTNLPKDRESLYYFHSRNIPSTNKNEDGIKIAMENIIKVFYRPINLAINPKEAGDKLVVKATPNGISIENPTPYYINLFKITVKNETIKLNKINNMIEPFSSKNYVVSNKTGAVNIHIINDLGGESVYNKKL

SEQ ID NO: 6431 - protein, 295 aa, Proteus mirabilis
LLRQSDQKAFAISHKWVFVTVNYNCLFLLKKEYDMSQSLHLTTRGSVLEIILDRPKANAIDAKTSHEMGEVFMRFRDDPSLRVAIITGAGERFFCAGWDLKAAAEGEAPDADFGAGGFAGLTELFDLNKPVIAAINGYAFGGGFELALAADMIICSDNASFALPEAQLGIVPDSGGVLRLPKRLPPAIVNEMLMTGRRMNAQEALRWGIANRVVSTTELMDSARELADQIANSAPLAVAALKEIYRATSELSIEEGYKLMRSGVLKYYPSVLHSEDALEGPLAFAEKRSPEWKGR

SEQ ID NO: 6432 - protein, 75 aa, Proteus mirabilis
GERHMPVIKVRENEPFDVALRRFKRSCEKAGVLAEVRRREFYEKPTTERKRAKASAVKRHAKKLARENARRTRLY

SEQ ID NO: 6433 - protein, 384 aa, Proteus mirabilis
EVINMDFRLNDEQELFVDGVRELMASENWEAYFAQCDRESKYPERFVKALADMEIDNLLIPEEHGGLNAGFVTVAAIWMELGRLGAPTYVLYQLPGGFNTVLREGTQEQIDKIMAFRGTGKQMWNSAITEPGAGSDVGSLQTTYTRKNGKVYLNGSKCFITSSAYTPYIVVMSRDAASPDKPIFTEWFVDMSKPGIKVTKLEKLGLRMDSCCEITFDNVELEEKDMFGREGNGFNRVKEEFDHERFLVALTNYGTAMCAFEDAARYANQRVQFGETIGRFQLIQEKFAHMAIKLNSMRNMLYETAWKSDNGLITSGDAAMCKYFCANAAFEVVDSAMQVLGGVGIAGEHRIARFWRDLRVDRVSGGSDEMQILTLGRAVLKQYR

SEQ ID NO: 6434 - protein, 309 aa, Proteus mirabilis
MSINVEVDNNHKETNKINDMVILSSIFGTKKITEKQLYFVLRCENKLGTLTALISVSQVMDNLYPEKKIDWELVPENYLIALFSQSLSTLLFPFSKEPMSSCVENICLGAEKGSCYPCVDTTLGHVFICDIKWKYELTVFPKNKIGFITSFILGYSKISLSLLKTILPGDVLLIDDIHFSFNVGDKKYFYFSWDEGNCVTLDAIVENSEENEEDEQNDAIIEDSIDLAQSLDLNSIGAIPITISFLLANKTLSIDQLEELAPGKKFILPDNAIRHINILANGKAIAQGELIKIKDMLAVEINKLSIKCE

SEQ ID NO: 6435 - protein, 327 aa, Proteus mirabilis
QLINLQVLLFCEHGEADIFMGDYNSLFKQHTECNIHTITLIRDSILASSQKLQEKLALLEEMEHLFNDMLINAESLVVFFNEIDEHFTHSNEEIENFAKWLNKIKDSANNIDKLSNQANILSINSAIEAGHIGHAGAGFSVLAQEMKSLSQKIQNQASEIASINNNVSARFTPIKQNTQKNQEQLKQIKNLVTEGHANLSALAQQANDLKNIFQFMSIQQFFNTVKIDHVLWKEAIYIHLLNNDDENCVNQHTECRLGKWYYQGEGRKFAGSEAFRRLEEPHKLVHQSGRLALAANMAGDQDAVVKYIQQMEQASVDVIKYIDALHN

SEQ ID NO: 6436 - protein, 1180 aa, Proteus mirabilis
PPVKILFLVYKMKMKNKSILYILCPLYIWPINCYSNYNINDMGDSIYNPFSIANNASQYYEFNHNRYEYIKHLHGRVLDKHSYNQQLMTPFGSTYIYATISDDTLSLYNRIADEGERNIQKKIPNYNVRETVYFSEELLPNELFISIDGGKTIKKINKENNPQLDLLYLSHISKNSKTVVGYAFAGARARLEQMVKNNSIFEDTIGCGTYNGCYVFAYNVYNNTFSILDRNMEIRYLTKDGNFILYEYKGDERKKLYIYDIYKKENFELTFDNVNKYLANHLEKAILLSPITEYPFLKGIKRRGVDIQKISDNGQVFIGQLNRDLPKKKLLDREYPKVAFITTASGPIRELSLSEFGSTKLADTSADGNYSVGWGDVWHNNYAIRLPTRTKTSSAIFSQALLYDFSNDKLINIGNLSTKKEESEFRNARALDITADGKYVVGWSETDEYNLKTIPKDLTGTGPHAFIMFHRHGFIYFNNHMYDLGTLDGGKDSEAHAISDDGRIIYGVATNERNNWRQVIWRNDEIDDKYFNTEQKEIADEKDKQAEQEKAELEKAEQERLARLQAEQEKAKQEKAEQERLARLQAEQEKAKQEKAEQERLARLQAEQEKAKQEKAEQERLARLQAEQEKAKQEKAEQERLARLQAEQEKAKQEKAEQEKAEQERLARLQAEQEKAKQEKAEQERLARLQAEQEKAKQEKAEQERLARLQAEQEKAKQEKAEQERLARLQAEQEKAKQEKAEQEKAEQERLAKLQAEQEKAEQERLARLQAEQEKTEQERLARLQAEQEKAEQERLARLQAEQEKTEQERLARLQAEQEKAEQERLARLQADKELPPVEDEQVQQAKAKVKEKETAKSSTAISKPIDVENSYKSMQLMAENSYKLIDMQQGQLRYLASATCSVGTEKACLSGFTHYQNIDKANAIQTGISGAYRFDINQTPLVVGLAIDSDSYSSLPTGYEYQGYPLPLIGFSVDLIPSLNPTSNGNALHLSLKGAYVNRKVTIKRPILDNTEAGKGHAKISGYYIDFQGYYPCTLNNLITVTPFAGLTFNQTSRSAYSETQGTKLAVHYQELNAHSLLAKIGLGIEYTVNAKLKLDSKAGLLWHLSHHQGDFQSHIDYLGQQKINYNDNKKQLAQRPFASVGLTYQLDKQSSVNTTTNWQMTPYRNQDIHMGIGYTYRF

SEQ ID NO: 6437 - protein, 739 aa, Proteus mirabilis
KIFLLLSLIKRKKRKKRNNSMNKINQSNEHSRLASPFVSEEVKNVIKNTTKQANAINNISNYVTTQQQKENQSKFDIPLLRVPHEQERNAKRINIQDDPQYKMTTFSLENDEDNTKPSLAEEEPKNNKKKDDHLDVSAQQNSSLPTSSPDHLENKKSNKDYDFLFLQLSYQHVIHEDILNKIKDPEKFDYYRDKLQKLSNGIDDLKELFKSGFNELDKTKGAFVDYWMEVYNQIKEKNFKKESEVKSFLNNCNIPDSLIQQLLLGNIHSKVDMEKALEDVFPFLNFPSDFSKLSLDELDNLSKKLDGFFDDSFNYLPNISLSEDKINKITSHTDELKALINKKESESIKKQLAEIRGLFKELTISQSSLELEIASNSLSGMSLLTFLLSKTRELTLKVMLHRSESEQKLFNEMQEVTEKSLKDKVEEQKSLIKKQEEIQFWAGIGLKILGGLLTLVAGVSSIFTAGSSMVLIGVATTLFVADAGLTIADEVYQSIHNKSFMDEIMQPISDAVMEAIDKVSDFLVSLVNSSLDGLKELGLDKKIIEEMKNSIQDKLKMATKILVTVVLFVAATALSFVIGPAMKGISDAVNKISNQQIRQILKKVLNDGLEAVLGKMIKDIIIKALEEALEKIDKQLAKEISKKASIMLNRTVVASKLTNSAATNTVNIYGSVIASKIIQSIAGSKKLTAVLDIIQKLMDKIMETYHENIDSITDILKNLSDKSSVSNKLKSDMIRNISI

SEQ ID NO: 6438 - protein, 287 aa, Proteus mirabilis
KRANLMIYYPDAFLDNLLLEDIQYGDLTCRALNINHQLGTITFTCREAGCVSGITLGCRLLEKLGLTVTAHLQEGDFAKQGDCLISAEGRADALHQGWKVVQNVLEWSCGVSDYMAKMLEIYHRYQPKGQIACTRKNIPNTKLLATQAVLAGGGIIHRQGCSETILLFANHRHFLSEPDNWLQQVTQLRQAAPEKCIVVEADNLQQAREALKAQPDILQLDKFSIEDITLLQQEAPQIAPRCHLSVAGGINLNTIEKYAQTGIGLMVTSAPYYAPPSDIKVRLYPKN

SEQ ID NO: 6439 - protein, 496 aa, Proteus mirabilis
KTYNTYNPYSGVCLMFKNLFVVLQKIGKSLMLPVSVLPIAGILLGVGSAGLSWIPVSVSQVMAEAGGSVFSNMPLIFAIGVALGFTNNDGVSALASVVAYGIMSKTMLVVAPWVLGLSPDSVEIQRLTDTGVLGGIIAGIIAASMFNRFYRIKLPEYLGFFAGKRFVPIISGLIAIFVGILLSFIWPPIGTAIQRFSEWAAYQNPAVAFGIYGVVERALVPFGLHHIWNVPFQMQVGEYVNSAGQVFHGDIPRYMAGDPTAGMLSGGFLFKMFGLPAAAIAIWHTARPENRVKVGGIMISAALTAFLTGITEPIEFSFMFVAPILYVIHAILAGLAFVICILLGMRDGTSFSHGLIDFIVLSGNSSKLYLFPIIGILYAITYYSIFRFLIVKLNLKTPGREVEDKNAKQADKSAMGQSLVAAFGGKDNISSLDACITRLRIGVKEIDKVDRDELKRLGAAGVVVVGSGIQAIFGPKSDNLKTEMDEYIRSIGTTEK

SEQ ID NO: 6440 - protein, 335 aa, Proteus mirabilis
LRYKMKKKRPSLQDVADRVGVTKMTVSRFLRNPEQVSEALRVKIARELDSLNYIPNRAPDILSNATSHAIGVLLPSLTNQVFAQVIRGIESVTDKYGYQTMLAHYGYQAEKEEERLISLLSYNIDGLILAERTHTPKTVKMLETAGIPVVEIMDSVSPCFDSAVGLDNIEASRKMVSEMIHRGCKRIIYLGARQDERTLMRLQGYEQAMQEAGLPIGHVMTPKSSSYSLGTELLHEARKQYPDLDGLYCTNDDIAIGAIFECQRMGIAVPEQIAISGFHGHDVGQVMTPRLASIFTPRDEMGQQAADLLLKRMKGKIARGQVIDVGFRIITGESI

SEQ ID NO: 6441 - protein, 466 aa, Proteus mirabilis
NFNKKVLMSNKTRIEEDLLGKREVPADAYYGVHTLRAIENFYISDRTINDVPEFIRGMVMVKKAAALANKELHTIPREIADTIIKACDVVLETGKHMDQFPVDVFQGGAGTSLNMNTNEVIANIGLELMGHQKGEYQYLNPNDHVNKSQSTNDAYPCGFRIAVYNSVIKLTESIELLKAGFDRKATEFEDILKMGRTQLQDAVPMTLGQEFHAFSVLMKEEIKNLKRTAELLLEMNLGATAIGTGLNTAPGYQKLAVEKLAEVTGLPCVPAEDLIEATSDCGAYVMVHAALKRLAVKMSKICNDLRLLSSGPRAGLKEINLPELQAGSSIMPAKVNPVIPEVVNQACFKVIGNDTCVTMAAEAGQLQLNVMEPAIGQAMFESISLLSNACRNLVEKCVDGITANKEICEHFVFSSIGIVTYLNPFIGHHNGDIVGKNCAETGKSVREVVLERGLLTEEQLDDIFSC

SEQ ID NO: 6442 - protein, 408 aa, Proteus mirabilis
TGNKSNTSGGLCLMIRKVLFLFSLFLFSFSVIVSASANDIPQLKTDRVIDSANLLTAQQFKALNTLLVNFENSRNDGSQFVVYIVPTTGKETIESFAFRVFNQWKIGRKGKDNGLLLVVAINDRNVRFEVGYGYEGALTDVLAGRIIRNEMLPFFRSNNYYAGIEQGVKNAIQAVNHEPISFTNSQINTNTLKIFHTHFILIYLVILGGVYWFQLIFSTRKIKTKINQLLAPRGRKKKNPADQKGKLSIKQRKQLKNYLQYSYYFPTFSTLFFPMTLCFAAAMFYTQVFLDGIIDNFVLVIIVILSLLCNFIVLVVLFGIINLLFPIYRQQRKEWKAICVASPFGSPFNQLPYSKRIRRRSGYSGSGGYSSSSYSSSSSSSSSSSSSSSSSSGGGGGSSGGGGASGSW

SEQ ID NO: 6443 - protein, 182 aa, Proteus mirabilis
HFCNIKCKYNNDYKDPHVLTIIGLLIIISIVTLLMMGKTSPIIAMSVIPLIGALVAGYSFTEISTFFELGIKKVSSVATMFLFAILFFSIMKDLHIFNPLIRMMISITRGNVIIVCIVTALVAAVVHLDGSGAATFLIIIPAFLPLYRRLGMSPYLMLLIMCTSMGVMNMVPWGGPLGRASL

SEQ ID NO: 6444 - protein, 183 aa, Proteus mirabilis
KVGNHLTTQLNNKKGGHLFAFLFFTGLICIKLGRFNFCIDNNKEDIPMHMRLLLIGIIALFMTGCSMQKSSDVDQSKFTDMRLNKPGQPQKPKQQTLSPVRIVEKTEDLLGAPFKDLGVVAGESCRQTLQDPPASLPAAKKRMAIKAAYKNANAVLLHECQIVTGMGCYQSAICEGSALLITQ

SEQ ID NO: 6445 - protein, 288 aa, Proteus mirabilis
HPCFPPCYPYIDKLIMATYLIGDVHGCYRELRQLLNQVNFDANQDTLWLTGDLVARGPDSLEVLRFVKSLGSALKLVLGNHDLHLLGVFAKISRNKPKDKLNELLNAPDADELINWLRRQPLLQVDEEKKIVMAHAGIIPQWDLATAKKCAREVEAILSSDSYPLFINSMYGDMPNNWSPELTGLPRLRFSTNAFTRMRYCFPNGQLDMICKDKPENAPAPLKPWFDLPNQLPNDYSIIFGHWASLEGKGTPENIYALDTGCCWGGVLTCLRWEDKRYFIQPSLTHLP

SEQ ID NO: 6446 - protein, 501 aa, Proteus mirabilis
VVIKGYFSVSLFKKENVTMRKTKIVATLGPASCSEQMIEKLILAGANVFRLNFSHGTREQHQSTAATIRQVAKKHRVFIGILADLQGPKIRIASFKNNAIQLTQGDSFILNADLDSTQGDEQQVGLDYPQLVQEVTPGNILLLDDGNIQLKVRAVNNNNIETVVTVGGKLSNRKGINLLGGGLSAPALTDKDKQDIHTAAAIQADYIAVSFPRNGADIEYARRLIVAAGSQAKIVAKVERAEVVSCQANMDDIIKASDVIMVARGDLAVEIGDACLPGAQKQLIARCRALGCPVITATQMMESMIENPMPTRAEVMDIANAVGDGTDAVMLSAETAAGKYPEEAVRAMARVAEGAERSFAANAENPWQSPSYYSQTGRWIALAATTAAFHNDKHLSVAALTDNGQSVTLLSRFMPNNNIYALTDNPALAGQLTVLRGVTPVTYQRQNNNDGDENIMQKLQTEGLLTDIHSLLITRLSTFEKTGESDCCHLVPVKQVTTALT

SEQ ID NO: 6447 - protein, 172 aa, Proteus mirabilis
NSNNDKENKQEAWMTGNHYSHSKHLGSSLFEVLIVMAIVAILSALSLNSYHQLLRQRQLVQSVREVMAFLAYQQQRSLLFNCKVQIVLWLSPINKIEAKSLTTPTTKESIQLGLSNQLIRSTATRFTFCGLRQTLRPMHFVLSNGDEEVKIIISSLGRIRACSQTIKAFSVC

SEQ ID NO: 6448 - protein, 461 aa, Proteus mirabilis
LSGKKRVNKLSNKLIDNPLNFYMNRDPSMHLIMSLVGMATLILIAILFSSNRRAIKLRTVGGAFLIQIGLGAFVLYSESGRKVLLAISDAVKNVIDYGENGMSFLFAGLVSDKMFELFGSGGFVFALRVLPVIVFFSSLIAVLYYLGIMQFVIKILGGGLQKVLGTSRTESMSATANIFVGQTEAPLVVRPYIARMTTSELFAVMCGGLASVAGSVLAGYASMGVPLEYLITASFMAAPGGLLFAKLLVPETETPDDQKDAFDNLSDEEKPANIIDAAASGASSGLQLALNVGAMLLAFVALIALINGILGGIGGWFGYEDFSLELILGWVFAPIAFLIGVPWSEATIAGSFIGQKLVINEFYAYSEFSKYLQDESQLAAAGLMALSEQTKVIISFALCGFANLSSVAVLLGGLGGMAPNRRKDVARLGMKAVLAGTLSNLMSATIAGFFFALTAMAVVAA

SEQ ID NO: 6449 - protein, 185 aa, Proteus mirabilis
TMLKLFKTIIKTGDATTKYPFKPLELPDGFRGKPEYSPEQCIVCGACTSACPANALTMETNLETGERHWQLFIGRCIYCGRCEEVCPTRAIVLSDMFETAVTQKSDLYIKGTFKLLSCRECHQPFTPRKSVDYAMALLVQSGWDAQTVEAMRPQFETCPECKRKHNLLSDGQENISMGNVGSVKK

SEQ ID NO: 6450 - protein, 316 aa, Proteus mirabilis
CNIKTDNYSLHLQMTRLLRIDIKQLFYLIALDKTQHFGQAAEMCHVTQPTLSMRLRNLEKELDVVLIKRSSRFEGFTEEGEKILKWAKTMQSAYDGLQAEAANFRQQLFGQLRIGIVPLTNLNPMLMLQKISALFPEISFQVLSTNSENIIDRLNSNSLDIGICYLEKANTQQHEIYALKQTELGLLFHRNHFMPSTRTISWHEAVKQPLALLNKENHFRQSVDLAFQRYNLHPKVLVESSSTLHLIQSVNAGFCASIVPIAKGMENLSQDLDVVPIVDATINAPLGIVIRKEEPRSILIEKCFAQMRTYLESTGL

SEQ ID NO: 6451 - protein, 236 aa, Proteus mirabilis
RGQNYYLFIRAYSSVQSDNKGIFSMLKRPLSIQHHDFAGFMLMECLFVMTISSILLVCIGRAYPYIINELTSSYQQYRLEIYLKQRLQLLETQLRRAGYCNGDCTVKKASLPASLKIGHYPYHPHGSCVLFVYDMNNNGRWESPEEQESDYFGFRLKNGQLEQRRGVQNCDSTGWQQIFEKEEIEVTEFILTPYTHYSPIKKRAFNYLSLSLKFQAKQNINLKVHYQTSILLRNIS

SEQ ID NO: 6452 - protein, 107 aa, Proteus mirabilis
LNKNIIVSIKNKSYRYAHIGIFIMSIKRTVKLGSSLLLLIFILSSALSSFFIYKMQNNFTQVDVLSARYDDVLMARYQLAIMRSNVNYLLQDKDSRVADRNKIIQHK

SEQ ID NO: 6453 - protein, 197 aa, Proteus mirabilis
HYKKVNNCLKEQYMKDTQSLHHVFILMGVSGSGKSAVANGVAQRIGAAFLDGDFLHPRANITKMASGHALNDEDRKPWLHALNDAAFAMQRTNKVSLIVCSALKKQYRDMLREGNHCLHFLYLKGDYALIESRLKERKGHFFKPQMLITQFETLEEPTNDEPDVYEIDISPSLDNVIENVINTIESVTKPITEESAV

SEQ ID NO: 6454 - protein, 290 aa, Proteus mirabilis
LTKKRDYMKQYLALCQRIIDEGEWIDNKRTGTRCLTVINADLEYDVANNQFPLITTRKSFYKAAIAELLGYLRGYDNAAQFRAIGCNTWNANANENSAWLNNPHRKGEDDMGRVYGVQGRQWQRPDGSHFDQLRKVVDNLTNGIDDRGEIVTFYNPGETALGCLRPCMHTHTFSLLGDRLYLTSYQRSCDVPLGLNFNQIQCFVLLALVAQITGHKPGKAFHKIVNAHIYENQLPLMRDVQLKREPLPLPKLHINPNIKTLDDIETWVTTDDFSVEGYQCHEAIKYPFTV

SEQ ID NO: 6455 - protein, 315 aa, Proteus mirabilis
PMKNNTDFRFILVMRKSRLQELIERFNTWSQAKFYLEHNHVEVTDYLNEHNLYQKQLTEAELILKSFGRFQLLERGLLPSYQFSSHDIVVVIGQDGLVANTLKYLNQQPVIAINPDPSRWDGKLLPFEIGQLKEIIINTINHKMPFNSVTFAQAKTNDGQSLLAVNDLFIGPKSHTSARYILQWGDSQEVQSSSGIIVSTGLGSTGWFQSILAGAMAITGKASHPLLQGFSWSDKKLQFSVREPFPSRTTGTALTFGTIEPDSPLQLGSLMPENGVIFSDGIEEDYLHFNAGCIVQINIADRQGQLIAPKGRQPI

SEQ ID NO: 6456 - protein, 68 aa, Proteus mirabilis
LQRNLKFLNINKIFIVYTLISNNSLSEIFLFGFNDYQSDIFSLTMTLNLFRRRYGTENNCYGGRSFRL

SEQ ID NO: 6457 - protein, 233 aa, Proteus mirabilis
NGGKLYLPRYFAEISTMMEVYNPPTDPWLHVLYQDEHIIVVNKPSGLLSVPGKALEHHDSIMSRIKADFPDAESVHRLDMATSGVMVVALNKAAERELKRQFREREPKKTYIARVWGKLEKPQGLVDLPLICDWPNRPKQKVCYETGKSAQTFYEVLEYEENATRVKLSPITGRSHQLRVHMLALGHPILGDRFYAHPQARALAPRLQLHAQELFITHPAFHSPIHFECLADF

SEQ ID NO: 6458 - protein, 110 aa, Proteus mirabilis
KNTLLEIPSWFNWNFLEAWGATPMQIIKKVLLPESLPGLINAATITLITLVGYSAMGGAVGAGGLGQIGYQYGYVGYNATVMNTVIVLLVILVFIIQFIGDRLVKLTTHK

SEQ ID NO: 6459 - protein, 343 aa, Proteus mirabilis
NRLNNNYFVQTGENRRISMSNSLTYCYLPDEIRKWPGLPLSLSGEEVMPLDYRAGDSGWLLYGRELDKKRISEFQHKLGVAIVVVSSWRIDDYQVVRIAGSLTRRIRRLSDECGLDVVPFGQIPRLRSPGLLVMDMDSTAIQIECIDEIAKLAGVGDKVAEITEQAMQGEMDFSESLKLRVAQLAGADANILQKVMDNLPLMPGLTSLVRKLQAMDWQIAIASGGFTYFADNLKQRLRLVAAVANQLEIKDGKLTGKVKGPIVDAKYKAQVLTRLAKDLDIPLEQTIAIGDGANDLKMLRKAGLGIAYHAKPKVYAQAKVAIRHADLMGVMCILSAGLKHEER

SEQ ID NO: 6460 - protein, 790 aa, Proteus mirabilis
ILMKKSYPTLLATLVWATIYAQPAYADLASQCLLGVPVYNKPLVEGDPNSLPVTITAKDMQGEYPRMIQYRGNVDIKQGNQTLSADNVELTQTEGETPLRMVTATGNVSYDDPQIILKGPRAWSNLNNKDTDIEEGKYQMVGRQGRGYANKMQMRGENRYTIMDKGMFTSCLPGDDSWSVVGSEVILDREEQVAEIWNARFRVANVPVFYSPYLQLPIGDKRRSGFLIPNGNYSRSSGFDFQLPYYWNIAPNYDATITTNYISRRGLKLDNEFRYLTKPGRGTIAVDWINHDSQYNKDKADEKAGYLARDSATRWLFYWGHSGVMNNVWRFNVDYTKVSDNKYFTDFTSQYGNTTDGYATQKFSTGYAQQNWNATLTTKQFQIFSDNKDARAYRAEPQLDLNYYKNDIGPFDFRTYAQFVRFTSVGENTPEANRYHIEPTISLPASTGWASFNNEFKLMATHYDQDIPDAYKKKYPHQKLDDSVNRVLPQFKSDMKVVFERQYDTNDITQTLEPRVQYLYVPYKDQSNINNFDSALLQSNYSGLFRDRMYGGLDRIASANQLTAGVTSRFYDSELVERFNISVGQIYFFERPKTGSSNEIINSKDETGSMVWAGDAYWRITDTLGMRGGLQYDRRLGSVSMGDAIMEYRRDSDHLLQLSYRYVDRDYIQATRVRPYDGGVNQLPEYQKGISQIGVVGSWPLAERWGLVGAYYFDTKDSEPVSQMVGLQYNTCCWAVNVGYERKIVGWKEDHSDIDNKWSINLELRGLSNNHSLGSQKMLERGILPYQRAF

SEQ ID NO: 6461 - protein, 290 aa, Proteus mirabilis
LAMNSRCASINKILPFSCVDGPGNRLAIFLQGCNLRCKNCHNPYTMGICDNCGDCIATCPQQALSLQNGVINWNADSCEQCDTCIQQCPRQSSPMTLTYTVDELIAITRKYAAFINGVTVSGGESTLQLPFLIDYFKAIKEAPDLRHLTCLIDSNGTLSLNGWQKIAPFMDGAMIDLKSWSEETHIYLTGRSNQRIKKSIKWLSEHNLLAELRLLYIPEKTDYLENIEPLSQFINSLDESIPIRINAFHQHGVYGEAKNWRSANKEQIINLQNELILRKVNLIKIPNIYT

SEQ ID NO: 6462 - protein, 399 aa, Proteus mirabilis
LIMKQITILGSTGSIGTSTLSVIENNPDEFQVLALVAGKNATKMAQQCRAFQPKYAVMSDEKSAGELKRLLANTSCKTEILSGSNAVNEIAALDEADQVMSAITGVAGLKPTLAAIEKGKRILLANKESLITSGRLFFDAVAKYGAKVLPIDSEHNAIYQSLPTGIQDNLGHASLEAHGITSILLTGSGGPFRYTPLDELDAMTPDQACAHPNWSMGRKISVDSATMMNKGLEYIEARYFFNASEAEMEVIIHPQSVIHSMVRYRDGSIIAQIGEPDMRTPIAYSMAYPHRTESGAKALDFFEIQALEFIRPDYQRYPCLALAIEASQRGQASTTVLNAANEVVVDAFLNEKVKFTDIAKINRKVVEHFDLSEPQSIDDVLEIDKLARLQTQQIIAQIV

SEQ ID NO: 6463 - protein, 337 aa, Proteus mirabilis
KIMNIDFSMIWFAIIIFATLMYIIADGFDLGIGIILPFTRDKIQRDTMINSVAPVWDGNETWLVLGGAALYGAFPLAYAVIIDALTIPLTLMLIGLIFRGVAFEFRVNALPKHRLFWDSAFIGGSFLATFCQGITVGAVINGFNVTERHFSGSALDWLTPFPIFCGFALLVTYALLGSSWLIMKTEHQLHRKMCTITVYLAITLLVVIAIVSLWTPLTHADIAQRWFSLPNLYFLLPVPLLVLACAWGIVRSAYNYGHYQPFLLSLLLVLIGFAGLGISIFPYIIPPSISIWQAAAPVLSQKFMLVGAVIIIPVILAYTSWSYYVFRGKVNANESYH

SEQ ID NO: 6464 - protein, 383 aa, Proteus mirabilis
RIMNSLIGSSVYRRQLTCGTLSVTPNCSLEHLDELFDIAERRNPKRAFLFVSKVLGRHIPVSPKKMRETYQQMAKQFPQSLEGPILFIGMAETAVGLGAGIFDEVRDRYPQALYLTSTRHPIADSELFCKFKENHSHATDHLLYLPHNLEQRQWIQQAKTIVLIDDEATTGNTFLNLLSALREEGKLTQIKQIIAVTLTDWSGDALQKRSPLPITTFSLVQGKWQWQANPDAPLPVMPNVNITASGQVAITGKQSWGRLGMTTPANDLGLFIHVSEGEKILVLGSGEFVWEPFLLAERLEKQGAIVKYSSTTRSPIATNFAIQSAITFTDNYGLGIPNFVYNVAHQQFDRILLCCETPAESIDSQLIKALYKVAPIVEVISYD

SEQ ID NO: 6465 - protein, 496 aa, Proteus mirabilis
MTMKLFGKDDEYKTFVLSIGNKKNISLGKDDISLGIKDLSLLISNSNRDFMIVNKDKEVLFLKFTLELKCALEKYILEKNKKKDRLKKLKDILEKERLTDKIKILDNKVIVSGIKDANDINVLFSSLLKNKDDSSTLFNKIFSNKNTIINSFISKKEKKISDDIENIANKIMRKPKFTLYNNVNKYQNIITISNKIFKEPENTDITKDDSHNKNNFEKTEKTDLSKKTKKSKKAALMEQLDKDKQKMNELLATSSQGLLKTVEYIDNLSNLISSKTDNGTCNSDLIDQFKMSIETLVKKCNVFNKDSQFLSKKDIEIELSDIKITIEELNEIIKKMDGFKSNQLYCFYKEADKSNFTTVNEINFNFKKVFFNNIKDMFSQLSSYNKSLKENKGFFLKLYKLLFKNKYLRKKEINDNAVKKLEILDRNLFLLLESLDFKNNYVPDWTCKLVAKIINESMPRNDIFWRFSKERTEWNKIYKSFIVDRSFIVERKREEI

SEQ ID NO: 6466 - protein, 360 aa, Proteus mirabilis
LGQNSVNVPYSTYIKNKMIKLTNINKVFKQGARSIQALSNINLHVPQGQIFGVIGSSGAGKSTLIRCVNMLEKPTSGEVWVDGRDLTKLSDKELTKARRGIGMIFQHFNLLSSRTVFDNVALPLELDNTPRADINKRVNELLELVGLADKKEYYPANLSGGQKQRVAIARALANSPNVLLCDEATSALDPATTRSILELLKDINRRLGLTILLITHEMDVVKRICDQVAVISGGQLVESDAVSEVFSHPKTPVSQAFIQSTLQLDIPDDYKERMKPEWEEGLFPLLKLEFNGLSVDAPLMSIVARRFDADINILSSQMDYAGGVKFGVMLAELHGKNGNTEKSIAFLEEHHVKVEVLGYV

SEQ ID NO: 6467 - protein, 772 aa, Proteus mirabilis
KIKNINLTIILIYGWSLGWFMKPMLHKILCINLCVLSVAMPKIALSDNYFDPNLLLNNNDNIDLSNFSKEDYIAPGDYSLSVFVNTEPLGEKTILFKANKEGKVVPVVTIKDLKLFGVNVSAISKLSDLPEDTEIDNIEAYIPNSRLTFNINKLTLNASFPQVNMDKSFQGEIPAELLDDGVSAVILNYMANFIKNRTTGDYSSHNNNFFLNLNGGVNIGPWRLRTNYSYNNSSGSDQRSSSDSEFSNTYVMRNIAYLKSMLKIGEITTGGNIFSSIPIKGISLATNQQMLPSSMRGYAPVVRGFANSNATVTIRQNGQIIYKSFVAPRNFIINDISAGGIGGDLEITIEEEDGSKRVYTQAYSSLPIMLREGQFEYEFSAGQYDGGITTDSKKSKFALGTFSYGINNSITAYGGLLIANGYTSGVIGSGVSLGLLGALSADVTLARANLDKTYHGQSYRVRYSKSLLSTGTSFDLTALRYSTKDYYDFSDYNNSGYELREGIAPWLSQRQKSSFQTSISQSLGKYGSMYLRGETSRYWGNSRVNNSVTLGYNTVLKGIAFNIDYSISRLKSDDNTWPENRQINFNMNMPLSVFSNASGLQNMNASYLLTHSNDGRTSQQAGLNGSAFDNQLSYGIYQNTDNKADSYSGNMNMSYSGSKGTLSGGYSYGKNRNSFNGSLIGGVVLHSKGVTLSRMLGDSIAIVSADKAKGAEINGNVKIDTFGNAIVPQLSPYDTNSISVNVSTLPDDVTLNETSMKVYPTRKGYFSKTISN

SEQ ID NO: 6468 - protein, 767 aa, Proteus mirabilis
RFRNVYMSKKKSPIPGVKPYNGPAGGWGALKATAIAVRTQMDAFIAPKTLLNTNQPDGFDCPGCAWPDKEHHSTFQFCENGAKAVTWEATKKRVTPEFLAQHTVTELLTKSDFELEGYGRLTHPLAYDADTDTLRPVTWEQAFTRIGELLRNMPSPDSVEFYTSGRASNEAAYLFQLFAREYGTNNFPDCSNMCHEPTSVGLPQSIGIGKGTVSLDDFDNTQLIIAIGHNPGTNHPRMMGTLHEVARRGVPIVVFNPLKERALERFTDPQSVIEMATYSSTNIASSYYQVKAGGDAAALKGIMKTLIEWDNERGNILDHDFIAEHTLGFEAVVEDLKQTSWQDIESESGLSQADIESVALLYANSPATIITYGMGITQHNKGTANVRLIADLLLMKGNIGKPGAGICPLRGHSNVQGNRTVGITEKPSVEFLQKIEQTFGFKPPYKHGHDAVNAMQAMVDGTAKALICLGGNFAVALPDPQQSFAAMRKLDLSVHIGTKLNRSHLLTAKNTFILPCLGRTELDVQALGRQSITVEDSMSMVHASSGKLTPASPLLKSEPVIVAKMAAATLTDSKTPWLRFTESYDLIRDMIEKTIPGFDNYNQRIRVPGGFRMPLPAVERVWNTPTGKAMFSVFKGVKENKMVMGDDVLRLVTIRSHDQYNTTIYALDDRYRGIFGRRDILFMNNVDMIARGLNEGDKITIETVSENRKLQLDNITVVSFSIAPGTVAAYYPEANVLVPLDYIDKESGTPSYKAIPVRIYDKKTQVA

SEQ ID NO: 6469 - protein, 241 aa, Proteus mirabilis
ALYLINSDDLRSSIFMQPQFENAKNTVKTLSVFDFDGTLTYHDSFIPFLKFAFGRRKFARRIIKMVFPTLRCFRRKLTRDELKEVLIKTFLTDIKEEWLKEKAEAFCKAYWSKLMRPAGLLAVAEEINRHAEVTICSASPAMVLQPFADRLGIKLIGTTLEVVDGVLTGKIIGNNCRCGEKIKRLERVYGDLTQYHLRAWGDSRGDHELLYAAQDPHRRYFHTGSNKSKKSPIKITLKKDS

SEQ ID NO: 6470 - protein, 60 aa, Proteus mirabilis
FIFLSTKIGNTELFFADKNSLTIVLTLFFLIMSLMTVFSSIPTWGCSLYLSILDVFLFIL

SEQ ID NO: 6471 - protein, 210 aa, Proteus mirabilis
LSLELIIQLRGKLMSIYAFEGVIPVVHPTAYIHPSAVLIGDVIIGAGVYIGPLASLRGDYGRLIVEAGANLQDGCVMHGYTDMDTIVQENGHIGHGAILHSCIIGRDSLVGMNSVIMDGAIIGEESIVAAMSFVKAGFQGQARQMLMGSPAKHVRDISDQDMQWKRMNTREYQDLTVRCRQSLVETTPLTAPEANRPRLRGTTEVKPKGQ

SEQ ID NO: 6472 - protein, 75 aa, Proteus mirabilis
YALEVYLTNLIISLGYTLFRIKFIGCLLRFNFECLSLDLSQRKYSMHRYIIYEITIINIKQHYSVNLWLSTDDNF

SEQ ID NO: 6473 - protein, 656 aa, Proteus mirabilis
LYIEIKIMKLTPLCCLFLVLLPCSVIAQTTYQQSIPDVLTVWSSPIAANPDVLTQQQMLEQNKVNAAQALATLPGIVMQKSGNRNEYTLKVRGFDSRQVPVFFDGIPTYVPYDGNLDLARFTTNDLASIEVNKGYTSLLQGPNLMGGAINITTATPRKPLEGHIAYSQGFARGADYAHNMSARLGARTEYGFIQISGSQLQQRFTPIPNADENNNAVGTHGRRSHSATDDKRGMIKVGWTPRASDEYTLTYVKQDGNKNSPPNSDPNAKGRYKYWAWPDYNKESYYYSGVTQLTDSINLQSRAYHDKFENTLYMYPKKGNRVDYSHYDDHSTGAALQFGIDMEESDLLSFAVHWKDDVHRAQKEKNGDWVRFKDRTWSLATEYQWVVSNDLDVVGAISYDWRKSIDTDKKADNNKQNAINWEIMAKYSLSNDDNIRFTISDRSRFPTQKERYTTEKPKDGSRGIINPNLDPERALSFDMTYEGYLNEKWGYQTSLYYNRVSDAIMAHTLYRHGEALFQNQNSGRVDYLGLDIGTKGKMTDWLELGLNYSYIHSDPKQVDHIEGLPKHKAYMWLTFIPVEQVRFTIMEEAQSWTYNRIDENNKLAGYTKTDLRLDYDVGYGISVNASINNLFDKSYQYTQGYIEDGRNYWLGAEYKL

SEQ ID NO: 6474 - protein, 268 aa, Proteus mirabilis
LMIDKSAVIHPSSIIEEGAVIGANVRIGPFCVIGSHVEIGEGTDIKSHVVINGHTRIGRDNQIYQFASIGEVNQDLKYRGEPTQVIIGDRNLIRESVTIHRGTTQGGNITKIGNDNLLMINTHVAHDCIIGDRCIIANNGTLGGHVTLGDYVIIGGMSAVHQFCQIGSHVMVGGCSGVAQDVPPFVIAQGNHATPYGLNIEGLKRRGFAKEDLHAIRNAYKILYRNGKTLEEAREEIAQLAADNNNQYVKIFSDFLENSAKSNRGIIR

SEQ ID NO: 6475 - protein, 269 aa, Proteus mirabilis
RDVDDWVSRVTIMLVLLQYIQSYLIDIFLLIARLFPIFMFIPFLNSRVLNSQLLKYIIIFYIALGIKPSITITGVLRETWAIVLISELIIGLVIGLLLATPFWIASAFGEFVDNQRGASIGDTINPTTGIESSEFASLTGLFCMAYFLATGGLVVLMSTIKESYDVFPIGYINKNIGYDFIGHWLNDMVKVAIILVSPVLITMFLSEVALGVYSLFCPQLNAFSLSLCIKGIIAFLVLLLFFTSAMTNELYHFFNSRYFYSIFMSIYHG

SEQ ID NO: 6476 - protein, 344 aa, Proteus mirabilis
LFTEENSVLINSLRSTLLFSALGLFSAFAANAQQTKPTLTVYTYDSFTADWGPGPAIKKAFEQQCDCELKLVALSDGVSLLNRLRMEGSKSKADIILGLDNNLIHAAKQTGLFAPSNIDTSKLALPEKWTDDTFVPYDYGYFAFIYDKNRITHPPKSMDELLNSQQPWKILYQDPRTSTPGLGLMLWMQSLYPNNTAEQWQKLANKTLTVTKGWSESYGLFLKGEGDFVLSYTSSPGYHILADKKDNYAAAIFDEGHYLQVEVAAKLKSSKQPELAQQFMQFMLTPAFQETIPTTNWMYPVIDMPLPEVYSVMPKPQKSLQFDADVVAKERQTWTRNWQSAVSR

SEQ ID NO: 6477 - protein, 123 aa, Proteus mirabilis
LIYEQGEAMNQQKIKLVLALVTGMTVTMISTATIAETSWYNEIDKTTSNVNNELSDTAISKKIEETLLPNPSIDSGSLSIRTEFGHVTVAGFVKNAEQEKQLIQIIEKIDGVKSVESSVNIQG

SEQ ID NO: 6478 - protein, 1213 aa, Proteus mirabilis
RVSEVIQAQVLDPYTLPLYQRRLIEASAGTGKTYTIGLLYLRLLLGLGGESAFYRPLSVEEILVVTFTEAATDELRARIRQNIHQLRLACIRHQVENDNNAYQILLDQIPNKMVAAQWLLEAERQMDEAAIYTIHGFCQRMLATNAFESGVLFEQVLIQDEYELKKRVCADFWRRHCYPLSYDVAYAVSEIWSGPEQLLYEIQPYLQGECPEIQGIDFDAKKETVEQRHQAVIEAIDKVKALWRHHCNEIADWITSSGVDKRSYSSRFLPKWIDEITAWATPLETKSYQLPDCLSRFSQATLHEKTTKGAAPEHALFAEIELLCQQSLTLRDVIIANAIPEIRQGIENEKMRRGELGFDDLLTRLDKALQREGGEALADAIRQRYPVAMIDEFQDTDPQQYRIFDTIYGEHTESGLLFIGDPKQAIYAFRGADIFTYIRARQQTDHHYTLNTNWRSAPGMVSAVNKLFLRSKTPFLFDHIPFIEVNSAEKNQHMKFIYQQKTVAPLNFWLAEGESLSTGNYEQLMASQCAMQIRDWLSAGDNQQAWLIEQDNKSAVTSADIVVLVRSRREALLIRDALDLLSIQSVFLSNRESVFETNEAKDLLWLLQAVVTPEKERVLRASLASALFGFNAQQIDELNQDEQRWNRYVEQFADYFVLWQKRGVLPMLRKVMIENQIAENLLASQAGERRLTDIMHIGELLQETSLQLDSEHALIRWLAQQISRPDAQAESQQMRLESDKNLVQICTIHKSKGLEYPIVCLPFACNYQEQKGALYHDRDEFYAKLDIFNQPDSVRLADEERLAEDLRLLYVALTRAKFCCYVGVAPLVKGNKRKSGLTDLHKNALGYLLQHGEEGNSELLHQSINQLLDDNIKVITLGDTSTHRYQSPHTTDIALDAAIFKRKINDNWRITSYSGLTAQHSARGYLFDSADLDALVQSIAPGLDTDAKGEKTAQHSDELSIHHFPRGAVAGTFLHSLLEELDFSQPIDESWMQEQLIAQGFEEKWTPLLVAWMETLFHTPLNAQGLCLADIPKEHQLDELQFYLPIEKEMSAAQLTALTRQYDPLSAQCPALNFQQVQGMLKGFIDLVFCWEGKYYVVDYKSNWLGESSEDYTQEAMSNAMRDHRYDLQYQLYTLALHRFLQQRLPDYDYQRHFGGICYLFLRGIDADYPGNGVYTYLPEEKFVEALDALFKGEALEVNGSKVNALGENNSND

SEQ ID NO: 6479 - protein, 461 aa, Proteus mirabilis
RFCLHLPVNYLTDLVSREDNFSALFASSGDVMSDSEDIFDAIIVGAGLAGSVAALVLAREGAQVLLIERGNYAGGKNVTGGRLYAHTLERIIPEFAQQAPVERVITHEKLSFMTQTGAMTIDYQNAETHNPNHASWSVLRGEFDQWLMAQAEDAGAQCITGIRVDKLVERDGKIVGVEADGDVLEAKAVILADGVNSLLAEQLGMTKRVAAENVAVGVKEIIELPESVIKDRFNLKDNEGVAWLFAGFPTDGLMGGGFLYTNKTTLSLGLVCGLHHIKDAKKSVPQMLEDFKQHPVVAPLIADGKMVEYSAHVVPEAGLRMQHELVRDGVLIAGDAAGMCMNLGFTIRGMDLAMASGEAAAKTVLSAMAKNDFSKQTLNEYLNHLAQGPLRDMKAYQRMPDLLDNPRMFTAYPDMVVGIAKDLFTVTDDAPVPMRKTIMRHSKKVGWMNLIKDGIKGVKAI

SEQ ID NO: 6480 - protein, 277 aa, Proteus mirabilis
YSFDFYPVKRGEAMPSQLMRTSAVFAFLISLLFTGVSFASTSTGSSRMLQADTFKSTTTSLPDLKKYPSGTQRKKAFLNVIVPIIDNINNKILRDREWLTAQRKAQHWGSADLKKLREICQYYGVTCTSPKKVNWDSLLARVDIIPTHFVATQAATESGWGTSKLAQQNNNLFGMRCGNRSCNNVPGKTKGYAAYPDIEGSVIAYMRNLNTHRAYNSLRSSRAQQRMTQQQLDPRQLITDLKGYSELGSSYNDYLTEMFDSNKKLITQVQLQSKRES

SEQ ID NO: 6481 - protein, 457 aa, Proteus mirabilis
IYIERGIMFGLDAFHLARIQFAFTVSFHIIFPAITIGLASFLALLEGLWLKTKEPSYLSLYQFWIKIFAVNFGMGVVSGLVMAYQFGTNWSGFSQFAGSITGPMLTYEVLTAFFLEAGFLGIMLFGWNKVGRKLHFFATCMVALGTLISTFWILSSNSWMQTPQGYAIENGVVVPVDWLQVVFNPSFPYRLLHMSIGAFLASALFIASCAAWLLLKGQNTAPVRKMFSMALWLVLIIAPIQAFVGDAHGLNTLEHQPAKIAAIEGHWDNATKEATPLILFGIPDMAEEKTKYAIEIPYLGSLILTHSLDKQIPALKSFAPEDRPNSSIIFWSFRVMAGLGMLMICLGLLSVILRKKKRLYHSPLFLRFALLMGPTGLIAILAGWFTTEIGRQPWVVYGLQRTKDAVSAHGDIQMSLSLLAFILVYFSVFGIGYFYMVHLMKKGPVVLKSDQLTQGEK

SEQ ID NO: 6482 - protein, 209 aa, Proteus mirabilis
ASSECSFRISRSIMEFVYPKANLIAGVDEVGRGPLVGAVVTAAVILDPANPIQGLMDSKKLTEKKRNALYDEIKEKALCWAIGRAEPEEIDKLNILWATMEAMERAVAGLSITPDMVLVDGNRCPNLPMASQAVIKGDSLVQEISAASILAKVTRDREMEQLDKLYPDYGFAKHKGYPTAFHMEKLASLGATPYHRKSFAPVKRALNLV

SEQ ID NO: 6483 - protein, 754 aa, Proteus mirabilis
KVLDNTMLTRLREIVEKVAMAASLPEALELLVKETCQAMHTDVCSIYLADIPHRCFYLMATKGLKKPKGRAVSLSFDEGVVGEVGRLSELINLADIREHPNFTYLPQVKEDDLRAFLGVPIVYRRQLLGVLVVQQKERRLFNESEESFMVTLATQLGAILSQVQTKGLFGQYRQSRIKALSVSTGVVMAYGWQEMSQPTLDHVFKASALDIKSELNRLTVALEDATSECRRFSKRFMANSQKESAAIFDLYSHLLNDPQLRQKMTGVIQQGYVAEWAVKVVIEKFSAQFSSLKDSYMRERASDLKALGQRLLFHLDDDLSTTNTWPDRFILVADELSANLLAELPEQQLAGVIVRDGATHSHSAILVRAMGIPAIMGADIQPELLHNRMLILDGYRGEIFIEPEPFIMQEYRQIIDEERVLSQLAEEQLEQQAVLKNGESISVQLNAGLSIKYEQRISVGIDGVGLYRTEIPFMLQSGFPSEDEQKNRYREILSFFPNKPVVLRALDIGADKQLPYMPINEENPCLGWRGIRILLDQPEIFLIQLRAMLKANLEFKNLKILLPMVTSIDEIEEAKALLLRACAEVSREMKCECILPPVGIMLEVPSLVFMLPQLAHRVDFISIGTNDLTQYLLAVDRNNTHVALLYDNLHPALLRSLNIIALECQRYQLPVSVCGEMAGTPMGALLLIGLGFRQLSMSGRSLPRVKYLLRHLDPAILQPFMQQVLKAETAIEIKKLSADFMERQGLGGLIRGGI

SEQ ID NO: 6484 - protein, 133 aa, Proteus mirabilis
RTLDLGGIMFTSSKVAIQVQSVYIESQSSPEEQRYVFAYTITIHNLNKHAIRLLRRYWLITNAQGNTTEVQGEGVVGEQPLIEAGSRYRYTSGAVLETPMGTMEGHYEMIDAQGRLFQIDIPVFRLAIPTLIN

SEQ ID NO: 6485 - protein, 550 aa, Proteus mirabilis
VVIEISQCSAFTCLSTRRSLLMSNPIFQQEVARRRTFAIISHPDAGKTTITEKVLLFGQAIQRAGTVKGRGSNQHAKSDWMEMEKQRGISITTSVMQFPYADCLVNLLDTPGHEDFSEDTYRTLTAVDCCLMVIDSSKGVEDRTRKLMEVTRLRDTPILTFMNKLDRDIRDPMELMDEVETELKIACSPVTWPIGCGKLFKGVYHILRDETYLYQTGQGHTIQNSRVIKGLDNPELDEAIGDDLAVQLRDELELVLGASHEFDHEAFLAGELTPVFFGTALGNFGVNHMLDGLVKWAPAPMPRQTDMREVTAAEETFTGFVFKIQANMDPKHRDRVAFLRVVSGMYDKGMKLHQVRTKKDVVISDALTFMAGDRSHVEHAYPGDIIGLHNHGTIQIGDTFTQGEMLKFTGIPNFAPELFRRIRLRDPLKQKQLLKGLVQLSEEGAVQVFRPLANNDLIVGAVGVLQFDVVVARLKGEYNVEAIYESVNVSTARWVECSNEKKLEEFKRKNEQHLALDGGDNLTYIAPTMVNLNLTRERYPDIEFHQTREH

SEQ ID NO: 6486 - protein, 1161 aa, Proteus mirabilis
DMADPRFIHLRVHSDYSMIDGLAKTGPLVKKVASLGMPAFAITDFTNLCGLVKFYGAAHGAGIKPIVGADVYLETELLGDEYAHLTILARDNVGYQNLTLLISEAYKHGYGAAGPVIKQEWLTTYKEGLLLLSGGRMGDVGKFLLRGNRALVEQCLEYYQTHFPDSYYLELIRTGRPDEESYLHEAVALASEKGLPVVATNDVRFLDSDDFDAHEIRVAIHDGFTLSDPKRPKHYSPQQYMRTEEEMCELFADIPEALENSVEIAKRCNVTIRLGEYFLPQFPTGDMSTEDFLIKKSKEGLEERLAFLFPDPQEREKRRPEYDERLEIELKVINQMGFPGYFLIVMEFIQWSKDNGVPVGPGRGSGAGSLVAYSLKITDLDPLEFDLLFERFLNPERVSMPDFDVDFCMEKRDRVIDHVADMYGRDAVSQIITFGTMAAKAVIRDVGRVLGHPYGFVDRISKLVPPDPGMTLEKAFAAEPQLPEIYEADEEVKSLIDMARKLEGVTRNAGKHAGGVVISPTKITDFAPLYCDPEGNNPVTQFDKNDVEYAGLVKFDFLGLRTLTIINWALEMINARRAKKSLEPVDISAISLTDQRSFDMLQRSETTAVFQLESRGMKDLIKRLRPDCFEDMIALVALFRPGPLQSGMVDNFIDRKHGVEEISYPDVKWQHESLQPVLEPTYGVILYQEQVMQIAQVLAGYTLGGADMLRRAMGKKKPEEMAKQRSVFEAGAIKNGVDGELAMKIFDLVEKFAGYGFNKSHSAAYALVSYQTLWLKAHYPAEFMAAVMTADMDNTEKVVGLVDECWRMGLKVLPPDINSGLYHFHVNDEGEIVYGIGAIKGVGEGPIEAIVEARQQGGHFKDIFDLCARTETKKLNRRVMEKLIMSGAFDKLGPHRAALMSSLEDALKAADQHAKAEAIGQSDMFGVLAEAPEQVERSYANVPKWPDQVVLEGERETLGLYLTGHPITRYLKEIERYAAGTRLKDLVPTPRGQMVKVAGLVLASKVFTTKRGNRIGICTLDDRSGRLEIMLFSDALDKYQHLLEQDRILIATGQVSFDDFNGGLKMTVRELMDINEAREKYARGLAISLSDRQINEQLLNRLRGVLEPHRSGTIPVHLYFQKHDACARLRFGATWRVTPTDMLLTDLRTLLGNEQVELEFD

SEQ ID NO: 6487 - protein, 393 aa, Proteus mirabilis
PIEETDLFSQKDKIMAQPSRISLQIKKTVISLAIAALGFTASSSALAYQKVHQPDNSYQQYISQRQTVDMLIQDALEAFKSPARVSDAGFTGKLPSNMEVVAQKLQQAYKLEPYRLDLLFSAASAYVYNNQIERAVTIYKQILEAAPDDIDALIYVTSWTRFEGKDKESEAYFNKLKSLNPAKAEELSRFFAQIDRVSKMPLSDKLTPADLATLNKTKGNNAIVTLGYALNPDGTMNQILIDRLNKTLEVAKQLPDAMIVVTGGVPKAHQTEGKLMADWLVKQGIPAERIFQDNYARSTVENALFSRYALTKHRIKTAVIISSGSHVRRADAIFTVASWQSGPSDITYLTVVAPDKPLAELQKTSKSDLQGIYRDGLKALGLWSFRSYPLEER

SEQ ID NO: 6488 - protein, 145 aa, Proteus mirabilis
HKEEQLSVEKRDDWLSYPFEEYSVDNATVREIDEVINVPNIGPVVVTSHEQERFVEWFSDRVPKHPWKALASRLFSSSLTKAILPEKVALHKNQKYSNKADIWLHSNSDLHFVVVQSGAMKTLVTVFRLNKSLKKSQNEIKMCVR

SEQ ID NO: 6489 - protein, 737 aa, Proteus mirabilis
TYGEKCMDLAFVMPFLTIIGCVILVILGLFGLFKAFYIKVPQGTALIVNDMTSQPKVHFTGALVYPVIYKKEFMRISLLTLEVDRRGKDGLICQDNLRADITVAFYLRVNETTEDVLKVAKAIGVDRASDHQAVSTLFSAKFSEALKTVGKQFELSKLFEDRQNFRDRIVDVIGKDLNGYALEDVAIDYLEQTPKSALDPNNIFDSEGIRKITEITAIHNIETNQKERDQELAIQKKNVETREASLALERQQADAEARQQREIDNIRARESSETLRVQEEERLKAEQARIQTQQEIEIREENRMREVEVAQQNRTRAVAIEQERVNRARELEIVAREREVELQRIEKEKALEEERKNISNVIRERVAVEKTVAQEEERIKEVREVSEAERMRQVTVINAQAEAEESLVRQVKKAEADESSAKHKAEEISTMAKAELEASVKQAEAKKRLAEGIEAEHAALGLAEARVRQATAEAEEKEGLVQANITAEQLLAQARGLKEKGLSEAQVMEAKAQAQQQQGFAEAKILEEKLAAQARGEEQQANAKEKLGLADAKILEEKLAAQARGEGQLGSAQAEVIRQRLKAEADGLTDKFKSMDHLSDTARAHEEFRMRLEKQFEQAMASIEANKEIAREQADVLAAALSKTNIEIVGGDGNFFNTFSKALSLGKAVDGFMDKSSFAKENVEKLINRTQQDKKLDVASLLKNPEVQELINGFMATKGAGQLIKEVTAKSDTPKED

SEQ ID NO: 6490 - protein, 511 aa, Proteus mirabilis
IYLENLPMSKDNKKAGIEPKVFFPPLIIVGILCWLTVRDLDASNEVINAVFSYVTNVWGWAFEWYMVIMFGGWFWLVFGRYAKKRLGDEKPEFSTASWIFMMFASCTSAAVLFWGSIEIYYYISSPPFGMEGYSAPAKEIGLAYSLFHWGPLPWATYSFLSVAFAYFFFVRKMEVIRPSSTLTPLVGEKHVNGLFGTVVDNFYLVALILAMGTSLGLATPLVTECIQYLFGIPHTLQLDAIIISCWILLNAICVAFGLQKGVKIASDVRTYLSFLMLGWVFIVGGASFIVNYFTDSVGTLLMYMPRMLFYTDPIGKGGFPQAWTVFYWAWWVIYAIQMSIFLARISKGRTVRELCLGMVSGLTAGTWLIWTILGGNTLQLIDQNILNIPQLIDQYGVPRAIIETWAALPLSTATMWGFFILCFIATVTLINACSYTLAMSTCRSMKEGAEPPLLVRIGWSVLVGIIGIILLALGGLKPIQTAIIAGGCPLFFVNIMVTLSFIKDAKVHWKD

SEQ ID NO: 6491 - protein, 198 aa, Proteus mirabilis
YRLEDNQFPRVYNVINEIKKDAQERMDKSVEALKSQINKVRTGRASPNLLDGIVVEYYGAPTPLNQVANVVAEDGRTLAITVFDRTLAPAVEKAIMASDLGLNPSSAGAIIRVPLPPLTEERRKDLIKVVRGDAEQGRVSIRNIRRDANDKIKALLKDKEISEDDERRSQDEIQKLTDMFIKKIDEALTLKEAELMEF

SEQ ID NO: 6492 - protein, 62 aa, Proteus mirabilis
MFSDAGWSSMVARRAHNPKVVGSNPAPATNPFPNFIFYKFPLNTLLIPTLFTITNILPVTEL

SEQ ID NO: 6493 - protein, 271 aa, Proteus mirabilis
RFEESMRYWGKLLGLIIGSFAGIGFWGIVIGVFLGHLYDVQRSKLSYGGRYNRDRQAYFFAATFQVLGHLTKSKGRVTQTDITLASTLMDRMNLHGAARQAAQQAFREGKEVDFPLRATLQRVRQICAGRRDLLQMFLEIQLQAAFADGQLHPNERKMLFIIIDELGFSRARFEHILAMMQAGQSFHYQQGQNYQPQTQGPTLSDAYKVLGIKEGDDVKTIKRAYRKLMGEHHPDKLVAKGLPPEMMEIAKQKAQAIQVAYDLIKKEKGFR

SEQ ID NO: 6494 - protein, 526 aa, Proteus mirabilis
RGEEMNQTTMLTILMFAPLVFSILAFLSPLLKAAARPIVTGIHTIGIFVLVIAALGTVADVMSHGEILAAAKWVHVDSLGALFLAILGIIGFLTGLYSIGYMNHEVDEGEISVRTLCNYYGFFHLFLFTMLLAITSNNLILMWAAIEATTLSSAFLVGIYGQRSSLEAAWKYIIICSVGVAFGLFGTILVYANAASFMPDPDQAIFWTEVLKYTHQLDPTLMHLAFVFILIGFGTKTGLFPMHAWLPDAHSEAPSPVSALLSAVLLNCALLIIIRYYIIIDAAIGTEFTRNLLLIFGFLSVAIAAFFILIQRDMKRLLAYSSVENMGLIAVALGIGGPIGILAALFHTLNHSLAKALLFCGSGNVLLKYGTRDLNVVKGMFKVMPLSAALFAGGALALGGMPPFNVFISEFMIVVAGLAAKHMGLTILLLLLLTVVLGGLVRMVAKTVFGPKPDVVAKGELGLLTTLPMIILIALMLLMGTHIPKPVSELLENAANIVMNIDESGSPNYTWPTTLISNPSISVQEK

SEQ ID NO: 6495 - protein, 292 aa, Proteus mirabilis
IWEDNLLKYRVITALILIPIVIAALFLLPPAGFGLVIIAISGLAGWEWAQFIGWHSQGKRIATGVGFAALLVLMQASLPDFDHLLDTAMIKNSLWAGLFWWVAAILLVVSYPNSANMWKNSVLLKLLFGILTIVPFYCGMMALRMLGYSTNSYTGAWWLLYVMLLVWAADSGAYAFGRLMGKHKMAPKVSPGKTLEGLVGGLITAGVVSWLFTRFAPITEVPNHLLLISGIVVIVSVFGDLAESMFKRVSGIKDSSQLIPGHGGVLDRIDSLTAAIPVFAGLVFLVSSGFQM

SEQ ID NO: 6496 - protein, 197 aa, Proteus mirabilis
CTILKYTKCPLVGGDLVEVDMELIRAINVFNKFSKQGRNIFLTKDLKMLFPDESPKTLQKSVDRLIAHDVLRRASKGVYIYTQGSLGPYPLERLAENIRRGHYNYISLESALSQYGVISQIPIDRLTIMSTGRSGEFVTPWGVIEVTHTAKRPLEILNTTVEGRGPLRIATKETAIKDLMKVGRNTHLIQREELNYV

SEQ ID NO: 6497 - protein, 314 aa, Proteus mirabilis
PVVLVHLLQGEVLYQLVVWLGALAPPFLAQLVVWLGALAPFFPAQLAVWLGALALLFLAQLAVWLGALAPFFPAQLAVWLGALALLFLAQLAVWLGALAPLFLAPLFLASLFLAQLAVWLGALAPLFLASLFLAQLAVWLGALAPLFLASLFPAQLAVWLGALAPLFLASLFLAQLAVWLGALAPLFLAPLFLASLFPAQLAVWLGALAPLFLASLFLAQLAVWLGALAPLFLASLFPAQLAVWLGALAPLFLASLFPAQLAVWLGALAPLFLASLFPAQLAVWLGALAPLFLAPPFLAQLAYLFHLQFLFVQY

SEQ ID NO: 6498 - protein, 140 aa, Proteus mirabilis
KKTLFSPLKFYWMPPLVSSWYWFILGTGINLNPDMDFFIGDLLMKIRPLHDRVIVKRKEVEAKSAGGIVLTGSAAGKSTRGEILAVGNGRIMENGEVKPLDVKVGDIVIFNDGYGVKSEKIDNEDVLIMSESDILAIVEA

SEQ ID NO: 6499 - protein, 316 aa, Proteus mirabilis
LNKLSFYITIIMVIRPNQHWFFRLFDWHGSVLSKIIFRLCLNIAMSIIAILVYQWYELLGIHLTVAPFSLLGIAIAIFLGFRNNASYSRLVEARTLWGNMLITHRNILRNIKALLPEDKQFNRDFSNLLIAFSWSLKHELRKTNPMVDLYRLLPRPLFDEIMNSPYPTNRILLHIGLKIGELRDNKVISDVIFQSINKDINNLSDVLGGCERISNTPVPFAYTLILQRTVYLFCALLPFALVADLHYMTPFVSVFISYTFLSWDSLAEELEDPFGVSANDLPLNAICNTIERNLLEMQDITPLPIKVKPDQYYNLL

SEQ ID NO: 6500 - protein, 140 aa, Proteus mirabilis
TLICNIVGVNMCEEDINKPLYLLIADWVQEQQRWVSAKEIAKNFDIPQCNAINIVSYILSDVKEIECETKSVPNQLEGRGCQCQRMIKVSHIDPALYSRLKGHTQSKSRLSAPEKLAAMIPHGLDHQQKWQWMLSKSQRR

SEQ ID NO: 6501 - protein, 985 aa, Proteus mirabilis
MSELTHDGVERQPLHLFTENAYLNYSMYVIMDRALPFIGDGLKPVQRRIVYAMSELGLNSSAKFKKSARTVGDVLGKYHPHGDSACYEAMVLMAQPFSYRYPLIDGQGNWGAPDDPKSFAAMRYTESRLSKYSQILLSELGHGTVDWIPNFDGTLQEPKMLPARLPNILLNGTTGIAVGMATDIPPHNAREIGQALTMLLDNPDAGLSDVMQYVQGPDYPTEAEVITAPEDIKKIYKTGRGSIRMRAVWQKEEGCAVITALPHQVSGAKVLEQIAALMRAKKLPLVDDLRDESDHENPTRLVIVPRSNRVDLEQVMYYLFVNTDLEKSYRVNLNMIGLDNRPAVKGLLTILNEWLVYRRQTVTNRLNHRLEKVLRRLEILKGLLIAYLNIDEVIEIIRYEDEPKAELMRRFALSDIQAEAILELRLRHLAKLEEIKLQAESDELEKERDSIVKLLNSPRRLNTLLKKEIEADAKEFGDERRSPIRPQEEAKVVNEQDMLPSEPVTIVLSEMGWVRSAKGHEIDPSTMSYRAGDSYHSAVRGMSNQPVLFLDSTGRSYSLSPNDMPSGRSQGEPLTGKLTFPPDASVKYMLAGAAKQEYLLATKEGYGSVLSYEEMETKNKTGKGLLTVSDETELLAPFLVDAEKKNNQHWLVIITDKTRILAISAEHLNEMNKKGRGTRLVALGKEQSDVIEQIVLIAKNEALTFTVDGQQQTLKAEEISYFSGDVGDEPIPLKHLHPEAVTVIMSEKGLIRCQKGHNIDAKSVGFKTGDDYFDAVEGMSNQAVHLIDTTGQSYTVDVDALPSGRSKGDDLTGRLKVQKGAQLRHVVMGESSDKILMASDAGYGFICSIDDLTSKNRAGKSLLTLPENALPLPPQRLNDELSDLIMIITQGGRMLIFEASELPTMVKGKGNQMVSIPASQAASGEDKVAWLRVLPENASVTLHFGKRKLTMSMNELQTFKAKRGRRGTSLPRGAQSIDHIDIETH

SEQ ID NO: 6502 - protein, 124 aa, Proteus mirabilis
EGDCHGFSALAAKERSAPSATRAIARTASSGYLPAAVSAESITASVPSPTALAISITSARVGMGFSIMDSIIWVAVITGQPRARQRAINCFCAPGRQASPISTAKSPRATIMTSDALIMSSILA

SEQ ID NO: 6503 - protein, 145 aa, Proteus mirabilis
NEFCSLYLIHLSIWCQYMYDNLKNLGIQHPEDIDRYTLRQEANNDILKIYFRKDKGEFFAKSVKFKYPRQRKTISDTQSGQGFKEVNEINTNLRYVIEELDQICQQDQVEVDLKHKILDDLRHLEHVVANKIAEIEADLEKLTRR

SEQ ID NO: 6504 - protein, 214 aa, Proteus mirabilis
IYCCHRTKSSPIKGYFMRKLVVGLVLLLIIIFVVLINSYNKIQKNDELVTAAASELLNQYQRRLDLIPNLVNTVKGYSNYESQVLQDVVKARASVGQINVNTRLFENSTLATSYQKAQDDLGKSLSRLLAISERYPDLKANTLYQDLMVQLEGAENRISVARGRYIEAVRHYNTQIRQFPYNFIAIVMGYDKKVNFTVESEQEIKVTPVVDFAS

SEQ ID NO: 6505 - protein, 519 aa, Proteus mirabilis
IHLCYLITGVDYFMSIERTAKVGSIILLAIFLVTSALSSFFIYQMQDNFASLNSLTTRLNNVQEARYELATIRSHVNFLVNIGHENLDMQETKARLVSEAKTLAAKSKETINAWERESKISADAQRNSEQLSALFIKLVDTIIAPIDTLAYENIDLSKDFSKLAELFDEYLVITQNVNDQIEDEQKWMFQLFIYTTCIALVILIGLLYLVIRWVNKTFLFNLNTLSAILQKVGEGNLNFSLPKNRKDEFGTLFSHVGDMQNALTSTIGLVKEEALVIKSGSAEIAAGNQDLSSRTEEQASALQQTAASMEEIKIAVVNNTNNAVLANSITAQTRDLAIDGASIMNDAITSMKKIEVGTLKVAEINDVVNNIASQTNILALNAAVEAARAGEQGRGFTVVATEVRNLAARSAEAAREINQIIRASVADVAHGRELVNKTGEHIQEIVTSITKVSDIMQGISIASEEQKVGIEQIAVAINQMDSVVQQNAALVEQGATSTMMLDEKAQNLTDKVSVFQIKE

SEQ ID NO: 6506 - protein, 269 aa, Proteus mirabilis
YGQCRECEKMSLPEIPINHHVSQPITLSDQVKKLKKTLLKDIQRSAYVYRVDCGGCNGCEIEIFSAITPVFDAERFGIKVVASPRHADILLFTGAVTRQMRVPALRAYESAPDPKICISYGACGCGGGIFHDLYCVWGGSETIVPIDVWIPGCPPTPAATIYGFAVALGLLDQKLKGQNHTEVDNEQASLLLPSIPLDTRVMIEREARRLAGYYQGRQISDHFLTLLDGATVQEVSGRVDEWLRQANDPRLAEIVKRLVHSLNQGGVHV

SEQ ID NO: 6507 - protein, 61 aa, Proteus mirabilis
STKCHCFDVEIDLGVGNVEVVPDIKGRIPLINWVQAGDWTEIAKEFAYEDAEEWREVTGKA

SEQ ID NO: 6508 - protein, 266 aa, Proteus mirabilis
SKECSRMSRFIDTHCHFDFPVFYHDLENSLALAQQAQVKKIIIPAVAQWNWDAVTELSRYNNALYCALGLHPLYIEAHTEQHLIELKTRLKTTPRCVAMGEMGLDNYMTNPHPEKQQQFLIAQLKLAIEFDLPVILHSRKTHDNLSAILRRYSVPRKGVIHGFSGSLQQAERFVQQGYFIGVGGTITYPRAQKTRRAIASLPLERLLLETDAPDMPVSGFQGEPNRPERILAVFSSLCELRQESAEVIANQLYLNSLQLFQLTDDA

SEQ ID NO: 6509 - protein, 117 aa, Proteus mirabilis
LSRCAFSIKIGCAVRQRYEVRVKLYIKKAPPWRCIIKSLWTDRVNVQEVKKNSSISYKVWNFQTTCKHNITTTKPKVLQYCYYTTFRSGLGSASTIGIYWLIIKGQIIMLRIKKTNN

SEQ ID NO: 6510 - protein, 88 aa, Proteus mirabilis
GWFRTSRKRRQYGKSKRKKIIPEGAVIVVDPELSYSSDLLVVARLDDSKEATFKQLVIDDEQKYLKPLDSQYSATAINDNGTIIGVAR

SEQ ID NO: 6511 - protein, 197 aa, Proteus mirabilis
VMSRILYLHGFNSSPQSAKAQGFKQWLSVTHPDIELLVPQLPPYPQQAAQLIEKLVKDNANDKLGLIGSSLGGYLAIWLSQRFHLPAVVVNPAVRPFDLLQDFLGDNENPYTHQKYRLAPHHMDELLALRIPTITSPELIWLLQQTGDEILDYRQAVSYLGACKQTVEQGGNHAFVNFERFFPEIVQFLKITSFSTH

SEQ ID NO: 6512 - protein, 637 aa, Proteus mirabilis
TVYRRPTPTQITLKCGYRLMEQNPQSQLKLLVTKGKEQGYLTYAEVNDHLPEDIVDSDQIEDIIQMINDMGIQVMEEAPDADDLMLAENSNDTDDDAVEAAAQVLSSVESEIGRTTDPVRMYMREMGTVELLTREGEIDIAKRIEDGINQVQCSVAEYPEAITYLLEQYDRVEAGEARLSDLITAFIDPNAEEVAESDDVNLGKDDDEIDNSADDEDEDEDEDSDTDSDSDDDNSIDPELARQKFTELREQYEKTRQSIKAKGRNHKDTELEILQLSEIFKQFRLVPKQFDYLVNNMREMMDRVRAQERHIMRLCVDQVKMPKKNFITLFTGNETNDTWFTAARAMNKPWSEKLAGIEEEVQRSLQKLQQIEVETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPSPEELAERMLMPEDKIRKVLKIAKEPISMETPIGDDEDSHLGDFIEDTTLELPLDSATSESLRSATHEVLGGLTLREAKVLRMRFGIDMNTDHTLEEVGKQFDVTRERIRQIEAKALRKLRHPSRSEVLRSFLDE

SEQ ID NO: 6513 - protein, 357 aa, Proteus mirabilis
CYNRSITPLREEEFGSVMRVLGIETSCDETGIAIYDDKAGLLANQLYSQIKLHADYGGVVPELASRDHIRKTVPLIQAALKEANLTAKDIDAVAYTAGPGLVGALLVGATIGRSLAFAWDVPAIPVHHMEGHLLAPMLEEKTPDFPFVALLVSGGHTQLISVTGIGEYTLLGESIDDAAGEAFDKTAKLLGLDYPGGPVLSKMAQQGVEGRFVFPRPMTDRPGLDFSFSGLKTFAANTIRQNDDSEQTRADIARAFEDAVVDTLAIKCRRALEQTGFKRLVMAGGVSANRTLRAKMAMIMEQLGGEVFYARPELCTDNGAMIALAGMIRFKGGTEGPLGVTVRPRWPLAELPALADK

SEQ ID NO: 6514 - protein, 251 aa, Proteus mirabilis
KLMLAIIRGIIVILYTIIVVTFGMIYCMFSPRNPKHVMTYGRLFGKLSHVFGIKLVERFPKEAKSYGPSIYIGNHQNNFDMVTMSNAVQPNTVTVGKKSLVFIPFFGQLYWITGNILIDRGNRSKAHSTITQVAEQIKAKKISVWMFPEGTRSRGRGLLPFKTGAFHAAMQAGVPIVPVCVSTTQGKIKLNRWNNGYVIVEMLPPIDVSKYNKDQVRELAEDCRQIMKAKIEELDKEVEEMNKRDFAGKLN

SEQ ID NO: 6515 - protein, 70 aa, Proteus mirabilis
LVIFGEVGLAGEIRPVPSGQERIAEAAKHGFKRAIVPNANMPKKNPPDMKVYGVKKLSDALSVLDDLDDF

SEQ ID NO: 6516 - protein, 67 aa, Proteus mirabilis; identical to SEQ ID NO: 5360

SEQ ID NO: 6517 - protein, 603 aa, Proteus mirabilis
KAVLSYESAAYSRSTTGVKGLMAGRIPRSFINDLLARTDIIDLIDARVPLKKQGKNHSACCPFHNEKTPSFTVNSDKQFYHCFGCGAHGNAIDFLMNYDRLDFVETIEELAAMHGLEVPYESGTGSSPIERHIRQNLYQVMEKLNQYYKSTLNTPDAQEARNYLAHRGLSEEVITRFSIGFVPTGWDNILKRFGQNPDNQALLLEAGMVITNDKGRTYDRFRQRVMFPIRDRRGRVIAFGGRVLGDDLPKYLNSPETEIFHKGRQLYGLYEAQQTHPNPAKLLVVEGYMDVVALAQFGIDYAVASLGTSTTAEHIQLLFRTTDNVICCYDGDRAGRDAAWRALETALPFLNDGRSLRFMFLPEGDDPDSLVRREGKEAFEKRMEQAHSLSEFLFDSLVPQVDLSTQEGNGKLYSLARPLIDQIPSETLRLYLLRELGNLTGNPDIEQMDRLFGRNSLHHETSYQPTKLRTTPMRILIALLIQNPEFCQLVPPLEGLNTEKIAGLSLFIELVSLCQAQPGLNTGQIIELYRENKFGKQLEKLAMWNDIDIDEIAEKTFTDTLDHLFLTAMDERLNALIAKERTEGLTQNEREEVQLIIQARVKK

SEQ ID NO: 6518 - protein, 217 aa, Proteus mirabilis
AVKRFSRRMWRMNRFVIAEPQRCIGCNTCMAACSEVHQAVGLQAHPRLTVVKVEDQTAPMLCRHCEDAPCASVCPVNAITHEDNMIFLNESLCIGCKLCGLVCPFGAITPSGSKPVNLPAVFDHFVPEEMLADVPASLPTTNPFLAWNAGIRAIAVKCDLCAFSDEGPACVKVCPTDALHLVEEDSLEEQMKARRLDSVMEPMTSLDDLSTLTQERK

SEQ ID NO: 6519 - protein, 388 aa, Proteus mirabilis
TMKREQIIERPDWREKATEYGFNFHTMYGEPYWCEDAYYQFSMEEVETLEETTEELHQMCLQVADKVANSEELLTRFQIPRHCWDFVRESWKTSQPSLYSRLDLAYDGKGPAKLLENNADTPTSLYESAFFQWIWLEDQINAGRLPQNADQFNSIQEKLIDRFAQLRDQYGMRYLHMSCCQDTQEDRGTVQYLQDCAEEAEVTTDFVFIEDIGLGERGELTDLQDQIISNMFKLYPWEFMFREDFSTKLADAGIRWLEPAWKSIISNKSLLPMLWEMFPNHPNLLPAYFYDGKAPDSLSRYVIKPLFSREGANIRIVENGKDIAVADGPYGEEGFIVQDFHPLPKFGDSYTLIGSWLVNDQSAGICIREDKELITQDLSRFYPHIILD

SEQ ID NO: 6520 - protein, 436 aa, Proteus mirabilis
MAVRWLFWSLLMTQSLLSDIDVLLIDDDEDILESYRHLLNLAGMVARVTDSPEKALSLLTPEYEGAVVLDIYMPAMNGMEVLARIQQIDPRIPVIMITGHGDIPLAVEAVKKGAYDFIEKPINPPLFLELVAKAHKERKSLLSLRKTMITTTQERLVGDSAQITAIRQQVQQIADIDKDLMIEGEMGTGRHLLAQLLHELSPHSDKAVTTVDCQNLVDIKPLIAQIEQEEVGTLILRSPYDLPSGAQRWLSAYLLDMERQGKRQFRTIAILENNTQQLVTEGRLIPEFYYYFSQITFSLPPLSARRPDIIPLFRAFLRQSAQRLGIAVPKIDRNYLDILKRYDWPGNIRELRNVAELYAVGIVKMVDSEQHRAIIPPEGPLDNLVDDYERRLIEDALYLFAGRVSDVADYLGIPRKKLYLRMKKHELDKESYKPKV

SEQ ID NO: 6521 - protein, 504 aa, Proteus mirabilis
SSKRCLMLSTHNHSQYNQERSAMINIVIVSHSKHLAEGIESLANQMLNPTHCRLAIAAGVDDEAHPIGTDAVKIMTAIESLAEADAIIVMMDLGSAILSTETAIELLDTELAQKVTLCSAPLVEGTLAAVVAASSGASLEKVLEEANHALTPKKMQLGENMGGSEPNDVTPSIQMHGKEAHWVVKNPHGLHVRPAATLVELLSKFRADYQLIKGDRRINPLSLNQLSLIQIRQGDEITLIASGEQENEAIDAFLALAKQGFGEALPDELTEQSLTGTLVPASPIKGPAFIWHELELAPIENLSAPLDSTIQIEQFNQAIKDTLNDLKHYAEKANHTLGEQIGAIFNGHIMMLDDEELLTNVIDRIKTDNVSAQQSWTNEMKERIQLYRTLSDPYLRARELDLRDLRNQVLYHLQQKTPPKFTPSQPSILVAKELFPSTLIQFDATQLLAITLAEGDSCSHSAIIATQMGLPMLVHLGDGLLKIKEAQELTLDLKSSELIIGSIN

SEQ ID NO: 6522 - protein, 217 aa, Proteus mirabilis
SNIFRRYFVTKTKWTCIRNTQCLPRRILVSFFIDQSIIGNMKRLQAFKFQLRPNGQQEREMRRFAGACRFVFNRALARQNKNHEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYRNSREVIGEVRNVTVSHAVNGTSAFRLSMKRQNHNMNQPQ

SEQ ID NO: 6523 - protein, 448 aa, Proteus mirabilis
SNIFRRYFVTKTKWTCIRNTQCLPRRILVSFFIDQSIIDNMKRLQAFKFQLRPNGQQEREMRRFAGACRFVFNRALARQNENHEAGNKYIPYTKMASWLIEWKSDTETQWLKEAPSQPLQQSLKDLERAYKNFFQKRTAFPRFKKRSKNDAFRYPQGVKLDQSNSRISLPKLGWMRYRNSREVVGEVRNVTVSQSCGKWYVSIQTEYEATEPQHESTSIVGLDAGVTKLATLSDGTVYPPVSSFKVNQRKLARLQRKLSRKITFSANWQKQKRKIQRLHSHIANIRKDYLHKVTSEISKNHAMIVIEDLKVSNMSKSAKGTTERHGRNVKAKSGLNRSILEQGWYEMRRQLEYKQLWRGGQVLAIPPAYTSQKCACCGHTAKENRQSQSQFECLECGYTANADINGARNILAAGHAVLACGGRVQSDRPSKQEPAEVIQRNAVGIHVL

SEQ ID NO: 6524 - protein, 354 aa, Proteus mirabilis
MKKLINRVDDVLSEQLQGFAKAHPEINLHPSSFYVTRHDAPVKGKVALLSGGGSGHEPMHAGFVGKGMLDGACPGEIFTSPTPDKMYDCAKAIDSGEGVLMIVKNYTGDVLNFETATELLHDEGVKIATVLVDDDVAVKDSLYTAGRRGVANTVLMEKLLGAAAERGDTLDDLVKLGHQINNNGFSIGIALQACTVPAAGKPSFTLPENEMEFGVGIHGEPGIDRRPFTSLNDTVDAMFNTLIENGHYQRTIRSWDRVNGDWIEETQEKQPLKSGDRVIALVNNLGATPLSELYGVYHRLALCCENFGLNIERSLIGSYCTSLDMSGISITLLKVDDALLTLWDAPVATPAMTK

SEQ ID NO: 6525 - protein, 499 aa, Proteus mirabilis
NLFRNISTPRITKSEDHLAFSILTIIAGALSMFSTYNIDVLTEQNHQYLPIENTLSLQNIFSISWHPSLWKSLPAKQLPEYPDIHALNYCKEKLKHYPPLILASEIRAFKNLLKLVANGEAFLLQGGDCAESFDDCQATIIRDLTFTLSQMSALIEQSTGLPVIKLGRMAGQYAKPRSQAFETQNGLTLPSYRGEIINGLDFSVKSREPDPIRMITAYHHSAATLNLLRAMNYTQYTKQQWALDINAHPGSTEPEHYFHLLEQLYHSQHHIINKQPDTSSYYVSHEALLLHYEESMTRQDSIDNKWYNCSAHMVWVGERTTDIDHAHMRYLQGIENPIGIKCSTRMFEEKLIKLIDTLNPSNEVGKIILIIRVGKDAIHAYLPELVRTVKEHQRAVIWQIDPMHGNTQSANDSMKTRHFNDIAEETRAFIHILHEMGIQAGGIHLEMTGQEVTECTGGLQQIRYTDLSHGYQTLCDPRLNRTQSLELAFLVGRHWHNSL

SEQ ID NO: 6526 - protein, 161 aa, Proteus mirabilis
MNISLIAALAADRIIGMEKAMPWTLPGDLAWFKKNTLNKPVIMGRVTYESIGRPLPNRLNIVLSSQPGNDDNVVWVKSVEEALQVAENNDEIMVIGGGKVYEQFLPMANKLYLTHIDAEVIGDTTFPDYEPDEWDSTFMEYHEADENNSHNYCFEILKRRK

SEQ ID NO: 6527 - protein, 181 aa, Proteus mirabilis
NCYRASDLFDSKEKTMSETMTAPKVVLTVGNSMMGDDGAGPLLADLMEANPIDGWMVINGGSAPENVSYQIRALQPQCVVIVDAADIGLKPGEIRVIDPDYIAEMFIMSTHNMPLNFLIDQLKDDIPDITFLGIQPDLVGFYYPMTEAVRNAVDKVYQGIKSWRVDYFPELEVCDEDDIEE

SEQ ID NO: 6528 - protein, 85 aa, Proteus mirabilis
RKHRKFTLIIIPGFSLREIKTVFIIGSILYLPFIGMDLGVSWHFISIKYDDDEPYYIIWTFKLNLLSPWMVGDCYLKDSLINILI

SEQ ID NO: 6529 - protein, 132 aa, Proteus mirabilis
TVNSRTLLMFSAISGFFYVAFGAFATHKLAPHLSPQHWEYIQLAMRYQIVHTLLLVGLAAILMRKTILWLYWAGIFFGLGILLFSGSLYCMALTQVRLLSYFTPIGGFSFLIGWILIFIGALRLRTPASRHE

SEQ ID NO: 6530 - protein, 547 aa, Proteus mirabilis
MKSRLKNLYKYLIENRKHEVNGWHKAYRDFYSQVAQIRERITSGEGLSQNDEAFLKQLIYEKSNGIASRGQSVLSNDNFQSFIKNKNFISALEKFILIPNSENFTIFSDTWSNQGKSNNPVLVNRVAAACTLEVSTTVDSGKFNQVFNWLIREGIIPVYPTEENQSWFAKNIFLLKSIKSEFDNELREGKTDEFYLSQFVWVLYENLSNPFSLKKQIIKYGAPGTGKTYQARLQTSLMFDIWKEEFTSNSRLTHASQIELVQFHPSFSYEDFMEGLRPVLGSDGNSQLRLQNGVFKEFCRSAGKWEIDVYGLGLAQKWESLTIKELLPFREKLSGEHWRDVFEISDTSKLVSEAVPPFFFIIDEVNRAELSRVFGELMYCLEYRGTRGCVKTQYANLNNEHTGMLKDAKGYLFFIPTNIYLIGTMNTIDRSVESFDFALRRRFRWEEVVPDMALLKYHLNQFCKAWLPLVDNLERLNELIAKEPLLGNDYQIGHAYLMDLKYATSLTVSEVRERVWDDCIRPLLQEYLRGTGKETELISSFGKAFGV

SEQ ID NO: 6531 - protein, 476 aa, Proteus mirabilis
TVWLFDIIKNGTLVDNQSYFVSEGILKNRRLGKSITLRTKSKGQWTYPHNDESAIWHFLNSVSRDVEKTLNDNISDALILFNDEDYEHNTDGGFIDVSGTDARNFNLDTGNLIGFVKRGDYSLKISSRFGDAFLQYIIADADGFLELENIGGESHADGYEWLLAYLWNIKFKRAYRLGLPKTYITRNDRISRVRGTINATDYFQNKSSGKYLCSYREHSYDSPATSLFIKAYEAVAHYSFCHQTRNIYSAFLTANQGIKRSQQEILRTSHFTNPFYNDYNVLIDLSKQVIGRKGSDFDSQQDSSAFFFDISMLFEYFIRKLIKRDGLRLLGKFELCQEIASGALSGYMRKLEPDLVIEIDERLFVFDVKYKAFDSQFGVKREDLFQLHTYIGQYGNIAAIKGCGFIYPISEERWASLNLEKTQGVISDIIHQQGQEIPFHVLFLKIPEDTYIDFNRKMKEQCSIFIDALYSKVLNQ

SEQ ID NO: 6532 - protein, 289 aa, Proteus mirabilis
RLVREKQGNLLESQLELSVDQQHTVRILQITDTHLFANVDDTLLGINTYRSYHAVLDAIKQQGLSIDLIVATGDLVQDQSFAAYQHFADGIARLPSPCVWLPGNHDYQPAMIDALNQAGILSAKQVLIGEHWQLLLLDSQIQGVPHGELSDCQLDWLTRCLESHKERDTVILLHHHPMPSGCTWLDQHSLRNSHQLAERVKDHPQIKMMLCGHIHQEMDEMWNGIRLLATPSTCIQFRPHCTNFSLDTVSPGWRYLELSLSAQGKRNIDTQVHRLVGKDFCPDLDADGY

SEQ ID NO: 6533 - protein, 71 aa, Proteus mirabilis
LVGLITRRSLVQIRPPQPIHNICSKLKFIDSVAGWSSLVARRAHNPKVVGSNPAPATNFYKCFRTRGGAAW

SEQ ID NO: 6534 - protein, 279 aa, Proteus mirabilis
PVQRKGKSMSLKFKSLAVVSALVGALALAGCGEKEKDPNHIRVGVISGSEQQVAEVAKQVAKDKYGLNVELVTFNDFVMPNESLSRGDIDINAFQHKPYLDQQIKDRNYKITAVGNTFIYPIAGYSKKITDLADLPDGAQVAIPNDPTNLGRSLLLLEKVGLVKLKEGVGLLPTKLDIIENPKNIQLVELEAPQLPRSLDDQKIYLAVINTTYASQVNLTPAKDGIFVEDKDSPYVNIIVAREDNKDDENVKKFIQSYQTDEVDSAANKIFNGGAVKGW

SEQ ID NO: 6535 - protein, 336 aa, Proteus mirabilis
KNKRFGMSSSFPQLSIVVAVFNGEKFLPQFFNCLHAQQLENWELILVDDGSTDNSRQILDKWEKHFPNVTILTQENQGVSVARNTGFAVAKGEYVAFPDIDDVIDKRMYPRLLEIAKADNLDVATCNGNYVYDDKNRPTRPIFPSTRLTTTEVLTGPQWLERALESKKFLHVTWLNIYRRQFLLEHGYYFEPGLHHQDIPWTTEVLLTAKRVKYIDERYYDYFIHSGSVSHTTPDDRIHVRTIYNYMKILEMLDAINQRHAEIAKTINACYWQIAKEGLGIIHSIDAISSPETKKQIVKVFFERGIWALIWKNAKDFRLKWRLGRRYFRLKKILAE

SEQ ID NO: 6536 - protein, 148 aa, Proteus mirabilis
HMESSTQLILILALATLAPFIIAAGTCYLKFSIVLVMTRNALGVQQVPSNMVLNAIALMMALFVMTPITKNICYYVIENKVDMSSPDAIESFSNEALGDYKKYLYHYSDPDLLAFFEQAQENRPNSDGDKENIENSLLSLYPAFPLGR

SEQ ID NO: 6537 - protein, 296 aa, Proteus mirabilis
GRMSINYLKFPEIDPVMFSIGPVSLHWYGMMYLIGFVFALWLANRRAAKPNSGWQKSEVETLLYVGFVGVFIGGRLGYVLFYNLPVFLDNPLYLFKVWDGGMSFHGGLIGVICAMIWFARRTKRHFFQVADFVAPLIPFGLGLGRIGNFINGELWGRVTLDTPWAILFPGSRAEDLQLVAQDPTTLLPIIQQYGVLPRHPSQLYEMFLEGVVLFIILNIFVRKNRPMGSVSGLFLIGYGAFRIIVEFFRQPDAQLGLFSGISMGQILSIPMIILGIIFMVWAYRRDKATPQTPTTH

SEQ ID NO: 6538 - protein, 259 aa, Proteus mirabilis
SHRRSEKRHGQSCGKWYVSIQTEYEATEPQHESTSIVGLDAGVTKLATLSDGTVYPPVSSFKVNQRKLARLQRKLSRKIKFSANWQKQKRKIQRLHSHIANIRKDYLHKVTSEISKNHAMIVIEDLKVSNMSKSAKGTTERPGRNVKAKSGLNRSILEQGWYEMRRQFEYKQLWRGGQVLAIPPAYTSQKCACCGHTAKENRPSQSQFECLECGYTANADINGARNILAAGHAVLACGGRGQSDRPSKQEPAEVIQTSV

SEQ ID NO: 6539 - protein, 65 aa, Proteus mirabilis
NKGRANKLIFAFFIKKTLTHHAEYGLMRLVARIAQSVEQGIENPRVLGSIPSPGTILKLVNQQFK

SEQ ID NO: 6540 - protein, 217 aa, Proteus mirabilis
IMTGALIVNNLAGLMMITSLLVIGARKPIASCWFYALQSFVLVMIFVTLANTLDAHQLTLWAITAFFTKVLLVPLILGFAFRKLSDPSANISVIKPALLMLLAAVIVILCWFVVEPIQIPMVAELKPALAVSLGHFMLGLLCIVTQRNILKQAFGYCLMENGSHLTLALLAWRAPELVEIGIATDAIFAVIVMAVLARKIYRTLNTLNVDQLTALKG

SEQ ID NO: 6541 - protein, 218 aa, Proteus mirabilis
DFNGGNMNILVIGAKGRVGQRLIEILLAKGHHVIGTTRKLSDTSVHHPSQYHEIELDITKPLSSITDLLPDNLEAIYFTTGSRGKDLLQVDLHGAVKTMQAAEKKGIKRYIMLSAINSLSPDKWTELIDYFTAKYFADLYLRDRTQLDFTLVQAGYLTEKQGTYKITTKLEDNATKGEITIDNVAATLAEILDKPNTFKKCIPILDGDEAIKTALSRI

SEQ ID NO: 6542 - protein, 114 aa, Proteus mirabilis
QKSGVDEFNKRWDQRSKSNMSSPVNVDVKLGINKFNVDEENPHIIIKQQPDMQVLDTLVKACPAGLYKKQQDGSVSFDYAGCLECGTCRILGLDSALEKWEYPRGTFGVEYRYG

SEQ ID NO: 6543 - protein, 264 aa, Proteus mirabilis
FYFGRHSNMSTELYLNSERSILKGRIMATPHINAEMGDFADVVLMPGDPLRAKYIAETFLQDVRQVNNVRGMLGFTGTYKGRKISVMGHGMGIPSCSIYAKELITDFGVKVIIRVGSCGAVLPDVELRDVVIGMGACTDSKVNRLRFKDQDFAAIADFELVQNAVSAAKAKDIKVRVGNIFSADLFYSPDPEMFDVMEKYGILGVEMEAAGIYGVAAEYGARALTICTVSDHIKKGTQTTSEERQTTFNEMIEIALESVLLLED

SEQ ID NO: 6544 - protein, 452 aa, Proteus mirabilis
IIFGVISMLSFFKTRKDLPLIEASNEKIRSIYKKYQWQVFLGLVLGYAMFYVVRMALGVVKKPMLDAGIVTTAELGLMGSAFFFTYAFGKFSNGFLSDYANIGRFMSISLIASSFVCIFMGMSTASLFFILLWGINGWFQSVGSAPSCVSIFQWFSPKQRGTVYSIWGGSRNIGEAITWILTATIVSFFGWRAGFIGAGIAGIAAGIILLMILKDRPRTYGLPDPASAYGEESEAVKSSDPKETRRAQLFVLKQPTVWIIAAACAAMYISRYAISSWAVLYLQGSKGYSLIDAGFAMSTYPIAGFFGAILAGMASDKLFNANRHIPTLIYGIANIAGFALMFWGPQSRVMDAIALSMIGFAMGGLVVFLAGLTACDLMPKNAVGAVKGFIGLFAYIAASAQELVSASLIKVTQVGDITHYDFTTVQYFWIGSAIVSMILATLVWNAKKVTMD

SEQ ID NO: 6545 - protein, 588 aa, Proteus mirabilis
AIVGFYLENIVKSQDLLGLSSANILNAEFEKKYRDVIAHFFSRDPQYWPIFQDKTIQSITQFRKTMTNDKDQLQRYENGQALFDRLMADGQIQQHINYPENDPNELLMLVSTLCKNWENPLAVENVIAMPSDPGVYGSILGLMGNPNMVYCEYSGVADVLEKVTIKKVAKLVGYDPEVASGVFTQGGTMCNLYGYLFGLRKSMPNSKHLGMAADQDYRIINSQGGHYSNMTNLALLGVDVNNKTIRIKVSEDNTINLEHLERELRACFTVKCKVPTIMLTTGTTDTFGVDDVKGVCELRDRLCEEFEIAVKPHIHVDAAVGWPIIFFLDYDFNSNPLAINDITLDGLRQNVAKFKHLKYADSITIDFHKWGYVPYTSSLVLVKNGNDFVALENDPENFTYFEHELEGQTHLQSTIECTRSGVGIFGAYSAMHYMGIEGYQTIIAHCLQNANYMRHQLLAMGNAKVIVPQNQGPSVGFKLYDPNLVSDPNVAFDLESTCATDKEAYDFMVHNAQWHRKLFLQRGKKGLFTNWVDSIACSKYAKNNRYVYIPGEKAVFMNPNTERSHIDNFLKIITEMSHSFSAKKVSKI

SEQ ID NO: 6546 - protein, 449 aa, Proteus mirabilis
GECGMSTLTLVLTAVGSVLLLLFFVMYARLHAFIALMIVAIGAGIFSGMPLEKITQTMQNGMGGTLGFLSIVVALGAMFGKILHETGALDQIAVRLLKSFGEKRANYALGIAGLVCALPLFFDVAVVLLIGVVFAVARRTGGNVVKMAIPLFAGVAGAAAFLLPGPTPMLLADQMNADFGWMILIGLCAAIPGMLLAGPIFGNFISRYVTLELPKDFDEPSLGQSKMPSFGFSLALVLLPLVLVGCKTIGARFVEPDSQLFNILEFIGHPFIAILVACLVAIYGLAIRRGMSKEKVMEVCSAAIQPAGIILLVTGAGGVFKQVLVDSGVGPALGNALIGAGMPIAVACFILAGAVRVIQGSATVACLTAVGLVLPVISELGYSGAQMAALSVCIAGGSIILSHVNDSGFWLYGKFTGATEGQTLKTWSLMETILGTTGAVVGMIFFAFL

SEQ ID NO: 6547 - protein, 90 aa, Proteus mirabilis
FDGGELVDMVYAANKAIYLIILLSAAPIAIATFIGLLIGLLQTITQIQEQTLPFGVKLVGVFVCLLMMMGWMGDKLLIYAKEMLTIGLAG

SEQ ID NO: 6548 - protein, 351 aa, Proteus mirabilis
FYIGNRLGIIMVSTHIGFPTETVIVFVVLAIGAIFIDLFMHRADKPITLKNAVFWSIFWVVVAMAFAGFLYVHHGAEVASLFVTGYALEKVLSVDNLFVMMAIFSWFAVPDRFRHRILYWGIIGAIVFRAIFVAIGTGLLSLGPYVEIVFALIVAWTAVMMLRSGNDSEEIEDYSQHLAYRLVKRFFPIWPKITGHAFLLTQKEVDVELAKPENKDITIGRGTKAALYATPLMLCVAVVELSDVMFAFDSVPAIIAVSREPLIVYSAMMFAILGLRTLYFVLEALKQYLIHLEKAVIALLFFIAVKLGLNATDHIWQHGYSISATTSLFVVLGVLALGILASFVFPEKKNK

SEQ ID NO: 6549 - protein, 191 aa, Proteus mirabilis
IYSGLIMQTKKVSILIVSLCLLLTSWASVAAQSVKYNFSVVFLAKTCEIVVPDNITFTSGEGASSVSANDIKNNKISQQIPISLTNCSTSSLSGTSVYISQGVTLTGTRDFFNNNVSGSFGVQLTDDSGSKTYKVNNSSVFKPSDDSVVWDNITSESSTKSLTAKLRCQKEGCTPEVGPFTATVVLSFFSD

SEQ ID NO: 6550 - protein, 448 aa, Proteus mirabilis
LSQGVNAMLAVELIIVLLAIFLGARLGGIGIGFAGGLGVLVLAAIGVKPGTIPFDVISIIMAVIAAISAMQVAGGLDYLVDQTEKLLRRNPKYITILAPIVTYLLTLFAGTGNISLATLPVIAEVAKEQGIKPCRPLSTGVVAAQIGITASPISAAVVYMASVMENPAMVGEGNTVSYITLLSILLPATFLAIILMSFIISWVFNSKLSDDAIYRQRLEQGLVELRNSKERRETLPGAKSSVMLFLLGVICVVTYAIINSPSLGIVKEPLMNTTNAILIIMLSVATLITVFCKVKTDNILNSSTFKAGMSACICILGVAWLGDTFVSSNIDWIKLTAGDLITGHPWLLAVIFFFCSALLYSQAATAKALMPMALALGVSPLTAIASFSAVSGLFILPTYPTLVAAVQMDDTGTTRIGKLVFNHPFFIPGTIGVILAVGFGFLFGGMIL

SEQ ID NO: 6551 - protein, 528 aa, Proteus mirabilis
PLMGKWLIPGLCASGLLLTVALLSFSALWFNAPSGDLSTIFADSYLWHVVRFTFWQAFLSALFSILPAIWLAKALYRRQFVGRTLFLRLCAMSLVLPVLVALFGILTVYGRMGWLAQICQWLGIDYHFTPYGLQGILLAHIFFNMPLATRMLLQALESISTEQRQLASQLGMNGWQRFRFLEWPYLWRQILPTASLIFMLCFASFATVLALGGGPAATTVELAIYQALSYDYDLHRAALLALIQLFCCLGLVLVSQKLKGTLFVGSHQKLSWRDPSDSLINKITDSLIIVLAMLFLLPPLLAVISDGLNSQLLGVLQQPVLWQAFTTSLIIALGAGGLCVILTMMLLWSSRELRLRHFKKAGQALEMSGLIILAMPGIVLATGFFLLLNSTTGLPESPYLLVILTNALMAIPYALKVLENPMNDIAARYNLLCASLNLRGINRLRWIELRALKKPLSQALAFACVISIGDFGIVALFGNETFRTLPFYLYQQIGAYHTQDGAVTAMLLLLLCFTLFSLIERVSGKSYD

SEQ ID NO: 6552 - protein, 323 aa, Proteus mirabilis
YIGGKNMKLEEVFNFYFNGKESFEQFYTLSLNDHIKEFNFNNKKCYSISDELKTIQLFLSKFIFENIEFRKDLVYSYRKGVNVVDCISPHRFNNYIYKTDIENFFPSIGYDLIKNKIIEKVKDISFLDTNDVMVHLSRILELVTIDKKLPIGFSSSPAISNFVMYDIDCKIDCFAKNNDLIYTRYADDIILSGKNNLDKNSINQEINNILNYNQDNVFHLNDKKTKIITKKFERNILGISISPVGTLSISRQLKKEIEVKIFFLINNKDKFVKFSEMDEMSAIFSLAGKLSYALGVDPVYINKLRRKYGNSIINKLIKNKGDL

SEQ ID NO: 6553 - protein, 317 aa, Proteus mirabilis
VIGGVMSQFSTVWVLSDVLSPLPELMGGASSLGQSINVFTFNDEQSIAAFKLGATAVFQLEGKPDDRIMEDYAQSIVETIKSHSDAGLVLLPNTRRGKLFAARLGHRLAAVVSNDAQSLSTQNDALVAKHMVYGGLAFGDETLTTPYCVVTASTGAFDVASETQATGTAQKVAWIAPSQSIICQSIQPRKINAVDLDKARFVVSVGRGIGSKENIAIAEELAKEIGAEIACSRPVAENEKWMEHERYVGISNLMLKPDLYLAVGISGQIQHMVGANGSQTIMAINKDKNAPIFQFADYGIVGDVMKILPALTRQLSN

SEQ ID NO: 6554 - protein, 400 aa, Proteus mirabilis
GVFMHIRNNSDNVTSIKKHYENIKEKYQIKNKINNVLNTLSSLYIEREKITLLSKISFFIKSIFNINVGVVFLLDKSQHAKINTLSILMRNGGEVYFKNCKLINSDFVSFKNKHLDTFFLTLSYAIKNDCHDDVKRLIQCYLYEKSKTKGDFITIINIAFNIINHYPKEMFEQLKKYHPKCDDMVYYSDFNYKQHIDMALSYVCKEINRKDNNELINSIMNLVTIMYSIYSVEMDKAFIVNITKCFIDKAMEYNTVNYINDAFKKSISNFLTNKLRNNEDVQKFVDDMLTLGVLEKKDIIKAKKMTMEDESFITKHNRRMQNIFTKNENSDEMKYTIANVIRNNHENILEKIDNECGDLKDKYKDILLDIIDYLRDDKDWNFDSLIIDYTYFIDNYLHLF

SEQ ID NO: 6555 - protein, 206 aa, Proteus mirabilis
GFIMKKNKLMLFTATLLLSSAGIISTASAEVTLKHGYIDIPPSRAFLCSSKGGNLNKNCGPIQYEPQSIEGDKGFPKGGPADGEIASGGKATFSALNAQSADRWHKVAMKSGENTFKWTLTAKHSTESWRFFITKPGWDVNKPLTRADFDLTPFCQRNDNGKIPTETVTLNCNIPERSGYQIILGVWDIADTGNAFYQVIDAEFKK

SEQ ID NO: 6556 - protein, 947 aa, Proteus mirabilis
EFIMSANSVFQQLWDKAQCTFSTKLNELAPFSEREQQFFAFSPFATEHLRVNPHWLTEIRQTPPVSDEWQNYSSQLKQQLTHVDNEDDLMAILRQFRHQQLVRIAWSQFFQLCDTPCTLKQLSVLAETLISVAKDKLYQQCCQQWGTPCDREGKPQPLLILGMGKLGGLELNFSSDIDLIFAYPENGVTQGGRRELDNAQFFTRLGQKLIKVLDQHTMDGFVYRVDMRLRPFGESGPLVMSFAALEDYYQEQGRDWERYAMVKARVLGAEKKEYCQILRQMLRPFVYRRYIDFSVIQSLRNMKSMISREVRRRGMIDNIKLGAGGIREIEFITQVFQLIRGGREPELQSHSLLTVLNVIAKLELLSAQETSQLADSYLFLRRLENLLQSIADQQTQRLPDNLEDKARLAFAMGFDDWQMLYQQINQKMQAVSVIFTQLIGEDDENEDEEDVSEFKRLWLLGRLPDSATLFHQGLTAEDRQAICQTLQLFRQDISKRTIGPRGRDVLDALMPKLLAKVCLQPQALVILQRITPLLLGIVSRTTYLELMQESDEVLTHVVRLCAASPMIAEQLTRHPLLLDELLDPHSLYQPLPLNAYQDELRQYLLRVPEEDEEQRLEALRQFKQAQLLRIAAEDIAGVLPVMKVSDHLTYLAEAIIHAVVHQAWSYMVKRYGEPAHLAQRDGLGFAVVGYGKLGGWELGYSSDLDLVFLLDCPMNILTTGAKQIDARQFYLRLAQRIIHLFSTRTSSGVLYEVDARLRPSGESGMLVSTIQAFDEYQKNEAWTWEHQALIRARMIYGDDQLQQMFARTRHETLCLARNATVLQQEVREMRQKMVQHLAPTQSNTFDLKASSGGITDIEFIAQYLVLRFSHQYPALTRWSDNVRILELMAKYQVMSEQEAQLLTQAYVTLRNELHHLALQTLPAVVDGDCFITERQWVLSSKQKWLDE

SEQ ID NO: 6557 - protein, 222 aa, Proteus mirabilis
IIFFIYLFLLENPIFEVIFMPLLALQQLSVQQAGKMLWHDLSFSLEAGERLGISAPSGRGKTTLGRVLAQWQMPTSGQILFNQQPLPKKGYCPIQLVPQHPDKCFNPFRTTGESVRDAWVPDSLWLEKLMIEPEWLTRRPNELSGGELARIALLRALDPRTQLLIADEVTAQLDAQIQAKIWQVLIDESQKRPLSLIIFSHNKALLEKVSTRIWWVDKEKIC

SEQ ID NO: 6558 - protein, 264 aa, Proteus mirabilis
EVIMDRKLMPALFVGHGSPMNVLEDNKYTRLWTTLGETLPKPKAILVISAHWYTQGTYITAMTHPKTIHDFYGFPPELYQIEYPAKGSIGLVALIEDLIDPMKLKLDMEQWGFDHGSWGILEKMYPNANIPVVQLSIDANQSPQWHYEFGKKLVELRREGVLVIGSGNIVHNLRMMDWQNDQAEPYSWALSFSETVERCLQSDKVPEALFTILSTQEGQLAHPTAEHFLPALYLLGLKQPDEKVTLLNNDIINKSLSMMTFQIG

SEQ ID NO: 6559 - protein, 223 aa, Proteus mirabilis
GAIMEIYLDTADIEEVRKLSQVLPIAGVTTNPSIIAQSAQPIETLLPELKAAMGGKGRIFAQVIARDIDTMIEEALRIGNIADNTVIKIPVTEAGLVAIKQLKQKNMLVLGTAIYSVSQGLMAALAGADYIAPYVHRMDRQGSDGVRVVRELQTLVSMHNLPTKILVASFKTPRQVVDCLLSGASAVTLPIELAYSIIRSPVVDDAINKFTDDWSLAFNRQSL

SEQ ID NO: 6560 - protein, 472 aa, Proteus mirabilis
WLVINWLLCVLMSIIYYKTKIVVSQIVTKLFSTNKKLAIMAKNTMETWVKEKKMTVAAQKNADDISTLFYNLIDKLVLDPNKLATIKIKANQFDQDFEHLDQLFEKYIQTRNKNSLYLTHKQDSMVEFSIYSTIISLIILLIVLYFVLHWINKTFVSNLNTLSEILNKVGNADLVFSVPQVKNDEFGKLFSRVSDMQKALTSTIFSVKKEAMDIKGGAFKIASGNQELSSRTEEQSSALQQTAASMEQIKIAVANNTDNTIEANNIINQSTDIVMDGANVMKEAVLSMKKIEQGAVKVGEINDVINKLANQTNILALNAAVEAARAGEQGRGFTVVAAEVRNLAAKSAEAAKEISQVLKASINDVTYGTNLVNKSGECMQEIVSSISKVNKIMQGISLASEEQRLGVEQIAVAINQMDTVVQQNASLVDLAASSTMMLNDKAQVLMDNVAVFNIDDLEKEPEQKQELINEQE

SEQ ID NO: 6561 - protein, 548 aa, Proteus mirabilis
LISMLTLLHLLSSVALLVWGTHIVRTGIMRVFGSDLRRILGKSINKKSNAFLAGVGVTALVQSSNATALLVISFVTQGLISITPALVIMLGADVGTALMARVLTFDLSWLSPLLILLGVMTFLSRKKERIGQLGRVGIGLGLIILALQLIVTSAEPITHASAVQAIFTSLSGDTILALLVGAIFAMVSYSSLAAVLLTATLSATGFMPLYISLCIVIGSNIGSGLLALISSRGQSISSRQVVIGSLFFKLIGALLVLPWITIIATKIQQYDFSPAEVIIYFHVIYNLVRCVLMLPFVGPMAKLCQKLVPELPVTGTEVAPRYLDPSAVDTPSLAIANAVRETLRLGDVVEQMLQRFQALMEGDRLQKREISQLEEEVELLHSSIKLYMAQIQQHDLGTEDSRRWAEIIDTAMNLQQSSAIIARMSGEVVNKSLDHHLNLSEEGRRELQTLLERLQSNLNLAMSVFVSGNMEHARKLRRAKHRFRLLNQRYSFAHVERLHLHNMQSIETSSLHTSLLGDMKRLNSLFCAVAYHALERSGSSSEQVNLQQ

SEQ ID NO: 6562 - protein, 356 aa, Proteus mirabilis
GDSMGKYIPVTLNNITALEFQSSLPQGKVALVCEGGGQRGIFTAGVLDEFMRSQFDPFDLLLGVSAGAQNLSAFACGQRGYARRVINRYTTNNQFFNPIRFVRGGNLLDLDWYIETTSKEMPLNMPKALRRFDSGREFYMVASRSDNFKANYFQPEKSTWLDIVKASSAIPAFYRNGVLFQDVVYHDGGISDAIPVKEAYRRGCRTIVVIRTVPSEYQYTTEWVDKMGKWFENGRFQRFLNMAQVHIETYTDTLRFIQSPPEDAVIIEIYPPTTLQSSALGSRLSALNHDYHVGRRCGRYFLATIGQHFSKKKFQQHDKKIFSLFENEAKADKAEDAEIIQKGTRSVHPEVRSVQE

SEQ ID NO: 6563 - protein, 60 aa, Proteus mirabilis
ASSIGSVTAEAPDNRQSTTWRGVLKLATSILVGKLCMETSVCNSLTTLTPSEPCLSIRCT

SEQ ID NO: 6564 - protein, 85 aa, Proteus mirabilis
INYIFYVVKKTKIWFLYWNDLPTSPSNFVSSKEGDLYMLSTVCHKYTKLHGRFCDALPRAGELSVKLVAIEIFETEMNYKYIGEN

SEQ ID NO: 6565 - protein, 60 aa, Proteus mirabilis
GCYINNIVDIAQSESSDFHNTLNFFPHLQKGNNSNAEPMGYFQKKLKIFKFVFVHHFKPL

SEQ ID NO: 6566 - protein, 150 aa, Proteus mirabilis
RLNMSNNTQHPFGHDITLDGLFQDFQKSKSWEDKYRQLIQLSRKLPALPDELKTTENEIKGCENRVWLGVELNNDGKYHIYGDSDGRIVKGLLAVILTTVENKTAQEIANIDILAIFEQLGLANQISQSRTDGVNAIIARLTSLTQTSQP

SEQ ID NO: 6567 - protein, 279 aa, Proteus mirabilis
GINMSMKINSDNVSNHYQTTINNSDEGEGIIDRNKLYKEVAPSLSKLTGIDRVNLKPVLSEPEHITKPDLKQILDSLEVDNDNDIYDHVKIEKTGIFNFVSDDMMKLIDLIVKYLETMIKKFEASREMGVMLMNIELDIADKVKDNLNKKANIMIGSAITSAGISMAIHGMGATFSIKGMGKELIGHSNPTIVMGNTISSLADPLARVADQTMQSESSTIEGEQKVLDARGSINNNVINNNNEIQREVTEVIRALLQAIEAIIHAQQDAASTISSNVRA

SEQ ID NO: 6568 - protein, 239 aa, Proteus mirabilis
NMNILKTISLLFSCFIFSASYSYAGLSLSQSRIIFSEGDKSQSVQINNDTDNLYLSQNMITADLDGKKDEHFIVLPPLKRLEPQSSVSIKILPRSLDTLPSDRESLFFFTAYLIPETKRGQQNNSGDLSLKINMVTKIIIKGFYRPNELAITSLDSHAKKITFKKVGNNVQVNNPTPYYFTVSNLKFDGKSYQSANAPMVAPFSSLNLAIDKSIKQVSWQYIDDFGGLSNTFENKIIVE

SEQ ID NO: 6569 - protein, 237 aa, Proteus mirabilis
NMRIIHTCLTNVHQHWRIQMSANALGMIIFAYLCGSISSAILICRLARLPDPRKFGSGNPGATNVLRIGGKLAAASVLICDVLKGMIPVWLAYYLNVPPFYLGIVAIAACLGHIYPVFFHFKGGKGVATAFGSIAAIGWDLSGLIAGTWLLTVLLSGYSSLGAIISALLAPFYVWWFKPEFTYPVALLSCLVLYRHHDNIQRLWRGQESRIWHKLKKKTEKTDKEIIQEAKEQEKED

SEQ ID NO: 6570 - protein, 295 aa, Proteus mirabilis
SRLFPFFDDIRISIMSLYQGDKALEALSLGKETQYHTHYDASLLQGVPRRLNRDSLSLTADNLPFHGGDIWTMYELSWLNSQGLPQVAIGHVELDATTENLIESKSFKLYLNSFNQTRFENWHIVEETLLKDLTACAKGRVHLTLYPLSHFTSQPIVDFVGECIDNQPIEIDNYQFDSQWLNGSTTDTLVEETLVSHLLKSNCLITHQPDWGSVMIQYKGKKIDREKLLRYLVSFRQHNEFHEQCVERIFHDIMTFCSPDTLTVYARYTRRGGLDINPWRSNCEFVPETGRLARQ

SEQ ID NO: 6571 - protein, 306 aa, Proteus mirabilis
VIGIYYHLVGSKLKKISLDLNIKKGFNSLYIGREEKKAQLTDQRINKKTSKIDKYKLQPHVGIEEKTVIKDIIRKNNVKTMVNEFLSAKKSSVFPIFVDKKINQQRYIKLVEKIIKKEPVNNDNIDLVSSATKQEKQAQIHQKENNSAYKNIESSMAMPLNNVSKVDTKEEPEIYQENINETNKVVPFSSQVTPIKTVIALPKVAKMVSQLPAWQVIDKKISMLTLPPSITYTFTKWKSRYHQAKIHFIDKQVQLIASSGRVYQTALENLKQYNGGLSIDLTNSHKNKSWYINSINAIYEREDENE

SEQ ID NO: 6572 - protein, 451 aa, Proteus mirabilis
AMGILWNLAAFIIVLGILITVHEFGHFWVARRCGVYVERFSIGFGKAIWRKTDKHGTEFVVAWIPLGGYVKMLDERVAEVAPERRHLAFNNKTVGQRAAIVAAGPIANFLLAIVAYWLVFMIGVPALKPIIADIRPDSIAEQAKLTPRMELKSVAGIETPDQNAVRLALVSKIGAKEVTFVVTQPNSLSESENILNLQQWNFDPERQDPIVSLGIMPVGARLDSKVVEVTPDSAAEKAGLQAGDRIVKVDGQPIDTWHPFTYFVRQSPNKTLELLVERNGASLVLNITPTAIALKDGSEVGQVGAKLQVLPPDEQYLIMQQYNPFSALYEASDKTWQLMGLTVKMIGKLVVGDVKLTNLSGPVSIAKGAGMSADSGFVYYLMFIALISVNLGIINLFPLPVLDGGHLLFLVIEKIKGGPVSERVQDVCYRFGVMALMLLMGLALFNDFSRL

SEQ ID NO: 6573 - protein, 191 aa, Proteus mirabilis
RIFMASYNTNDFRSGLKIMLDGEPAVITECEFVKPGKGQAFARVRLRKLISNKLLEKTFKSTDSAEGADVMDINLTYLYNDGEFWHFMNNETFEQLAADEKAVGENAKWLIDQAECIVTLWDNRPIAVVPPNFVELEIVDTDPGLKGDTAGTGGKPATLSTGAVVKVPLFVQIGEVIKVDTRSGEYVSRVK

SEQ ID NO: 6574 - protein, 408 aa, Proteus mirabilis
HKLIMKPFSPTVFRQQFPAIEENIVYLDSAATALKPVAMIEASDEFYRHSSATVHRSQYQQAKKMTQHFEQARQQVAQLLNVADSDTIIWTQGTTGSLNLIAQGYFRPRLQAGDEIIVSEQEHHANLIPWLMLAEQTGAKIIRWPIEDNFLPSIATLTTLLTARTRVVAISQMSNITGAQIALDKVSQCVHQYDDCLLVVDGAQGIAHHATDISALDIDFYAFSAHKLYGPNGLGVCYGKRELLEVMSAWQGGGKMLTTASFNGFVPAAIPHRFEAGTPNIAAVIAFSATLDWLQTQDMAQANQYALTLADKAQARLEQLEGFISYRAPHSPVLAFNFEGIHHSDLAALIAEQGIALRTGQHCAQPLIDALTISGCLRASFMPYNQLSDIDRLVDAVKFALSLLKDED

SEQ ID NO: 6575 - protein, 356 aa, Proteus mirabilis
VFIMAEKTEKPTQKKLDDSAKKGQSFKSKELVSGLVYFIGVIYLFNQVKLDEFNQFYQSLLLHPTGISLKSYVEVISKLFFDIVLPIIIVTFLSGAIPSLFSSHFKLATEAIKIDFNHINPISGFKKIFSIRTIKDFLKTILFIIIFLITCYVFMILHMGEVVILYRADLEGVIDKWCSLVVSFIFIFFILSIPILILNIIADFFLFIKDMMMEKHEVKQEHKNMEGNPEIKSVRRQLHQELLDEPMKRVIRDSSAVIVNPTHVAVGIYFDPDNGIMPIVSLSCTNAKALAVKAYAKKVGTPVIRYPELARKLHHKYHLFEVIIDQDLLDVMDVLIWLKRVEIEGLSREEMDYINN

SEQ ID NO: 6576 - protein, 152 aa, Proteus mirabilis
QIIIRIINVLKITLITIMKIKFILLGVFGGILLLSGFVAHAIKTIPLDMQKEATVVSVEKPKIVSRQFPYYPTGAKTANIEGDVEVRFDVDKNGNVQNIRISDDPIAAIFAPSVSLAMKHWRYESGKPAKDLKVVIQFRLENVKHNGFNQSH

SEQ ID NO: 6577 - protein, 139 aa, Proteus mirabilis
VNIMSRKDRMLAQLGIRQWVLRKPAVLKGEHSVQFPDTTRLLIITDDVVDLNNGLFSDIFSTMGIDKSEIYCITSEDVSLLTGSFTPACWLLGTDITLPAQYTSLRSPSLHQLYFDANAKRDLWKQIYQHEDHFPIKPC

SEQ ID NO: 6578 - protein, 182 aa, Proteus mirabilis
LFIIDERIIIMSAYEKMSEKELDQLANYIVSIVQNGASIKDESEIPDGFMEGDYSFAYDFYQKGKLDEAEAIFKFLCLYDFYNVDYIMGLAAVNQLKKQYQAAIDLYALAYLNAKNDYRPVFYAGQCNLSIGEKEKAKYCFHQVAQNINDQTIKEKANSYLELLKDIPLVVLNKEEEKEEKE

SEQ ID NO: 6579 - protein, 446 aa, Proteus mirabilis
DAVMQPRNFDDIRFTSVHRRVMLWGSGGPFLDGYVLVIIGVALEQLTPILQLDTRWIGLLGAATLAGLFIGTSLFGYICDKVGRRKMFLVDIVAIAVISIATMFVSTPIGLLVMRFLIGIVIGADYPIATSMITEFSNKKQRAFAVGFIAAMWYIGATCANLVGYLLYDVQDGWRWMLGSAFIPCVIILIGRFDLPESPLWLIRQGRIKECNKMMIKLFGEPVVFEAEDAKTTRFIELFNKRHFSFVLFVAVIWTCQVIPMFAIYTFGPQIVGLLGWDTGRSAALGNVVISLFFMLGCIPAMFWLNQTGRRPLLIGSFAMMTLALFTLGIFPNLPILFVILAFATYAFFSGGPGILQWLYPNELFPTDIRASAVGVIMSISRIGTVISTCALPAFIATYGINTTMQVGAAISLFGMMVSVLFAPETKGLTLKQTSTMPMRRGKKSL

SEQ ID NO: 6580 - protein, 107 aa, Proteus mirabilis
GLSMLDPKKIEQVARQIQNVLPQGIKDLGDDIDKKIRAILQSQLNKLDLVNREEFDVQTQVLLRTREKLARLEQRLNELEAGQQAPAEVAQIEEVDVIVETGNDSKA

SEQ ID NO: 6581 - protein, 253 aa, Proteus mirabilis
LVTIYKKKTKISRYSFTYYLVIFYFCGLYMNFSHFNKVMFAASLLATGFSYADSDRPLLSLSVSQSGGTALNSEGSLDTRTPASQSRVLPIWGDEARARGYDLPEPFGASYSYMNLRQDIVVDKIGFIMPKNPETANALKIEAGHTREKSETHMLKLDSWVFPFMNVYGLYGRTKGKSKTTLKGGSFGGFPLNFIEGMPFNLDFKGDTYGAGFTLAGGYNQFFGTFDLNYTKTNLDILDGDIKALVISPRVGY

SEQ ID NO: 6582 - protein, 410 aa, Proteus mirabilis
RGDIMTEHLSMPQFGPLAGVRVVFSGIEIAGPFAGQMFAEWGAEVIWIENVAWADTIRVQPHYPQLSRRNLHALSLNIFKDEGRDAFLKLMETTDIFIEASKGPAFARRGITDEVLWEHNPKLVIAHLSGFGQYGDPQYTNLPAYNTIAQAFSGYLIQNGDKDQPMPAFPYTADYFSGMTATTSALAALYKVQQTGKGESIDIAMYEVMLRMGQYFMMDYFNGGEICPRMTKGKDPYYAGCGLYRCQDGYIVMEVVGITQIEEIFKDIGLAHLLGTPEVPKGTQLIHRINCPHGQLFEDKLDEWLANQPITAVLKRLSELNIASAKVLTIPELEGNPQYVARESITQWKTMSGETCKGPNIMPKFKNNPGKIWRGMPAHGMDTNAILKNIGYSDEQIRELVDKGLAKIVE

SEQ ID NO: 6583 - protein, 198 aa, Proteus mirabilis
RELIMVSLRKDQTVSLSKQAPALSHLMFGLGWDPIKKKGFLGGLFGGNNSIDLDASCVLLDVNGKQIDTIWFRKLKSTCQSVIHSGDNLTGEGDGDDETIFVDLNRLPSLVEYLVFTVNSFRGQTFNEVENAFCRVVDKTTNKELAHYKLTEQGAHTGIVIAALQRNQGQWDFTAFGSPCKGLVIDEMMPDILATVVR

SEQ ID NO: 6584 - protein, 575 aa, Proteus mirabilis
WNLIMRTSHYLLSTLKETPADAEIVSHQLMLRAGMIRKLASGLYDWMPTGVRVLRKIEKIVREEMDNAGSLEISMPVVQPADLWQESGRWEQYGPELLRFTDRGERPFVLGPTHEEVVTDIVRNEITSYKQLPLNLYQIQTKFRDEVRPRFGVMRSREFIMKDAYSFHISQESLQETYDRMYQAYSNIFTRIGLDFRPVLADTGSIGGSASHEFQVLADSGEDDIVFSTASDYAANIELAEAVMPATPRSPATEELRLVDTPNAKTIAELVEQFNLPIEKTVKTLIVHATEESGHKLVALLVRGDHELNEIKAEKCSIVASPLVFATEEEIRQAVNAGPGSLGPINLPLPIIIDRAVSVMSDFGAGANIDGKHYFGINWERDLPLAEMADIRNVVEGDPSPDGKGTLLIKRGIEVGHIFQLGKKYSEALKATVQNEEGHNQVVTMGCYGIGITRIVAAAIEQNHDARGIIWPDAIAPFQVAILPMNMHRSYRVKEVAEKLYADLRAQGIDVLFDDRKERPGVMFADMELIGVPHTIVIGDRNLDNEQVEYKARRSDDKSLVNVNDVVAFIKEQLV

SEQ ID NO: 6585 - protein, 342 aa, Proteus mirabilis
GVIIIMSSLSPASEVILRHLDHFADRHVLIAGDLQDTLASQIQAKSVRAYTNQYHQWLPLLKSMGDNAFFGLAADQSFVKYCDTLIYFWPKNKNEATFQLRSLCASLSVDTEIFIVGENRSGVKSATELMNGIAKLKKIDSARRCSLFFGSLTYQTLFDRNNWWQTYRYDDLTVMALPGVFSQTALDEGSRLLLSTFDDAMVGDLLDMACGCGVIATVLGKKNPMLKLTLCDVNAAAISSSIATLNVNELEGRVIASNVYSAVEETYDWIVSNPPFHDGLGTSYQAAEDIIRLAPNFLKKGGKLRIVANAFLPYQDILDHVFGSHEVLASTGKFKVYQATKK

SEQ ID NO: 6586 - protein, 336 aa, Proteus mirabilis
TRIMQTKLKKPLVITPGEPAGVGPDLIISLAQSQWALPWVVCADPQLLRARAQQLNLPLTLVEYSPDNPPTAHIPGQICVLAVELTDPSVVAGTLNTANGHYVVQTLARACDGCLNGEFSALVTGPVHKGVINDAGVPFTGHTEFFADRSHCQRVVMMLATDTLRVALATTHLPLREIADAITGELLNEIITILNHDLKTKFGISSPHIYVCGLNPHAGEGGHMGREEIDIIEPALEQLRQQGIQLHGPYPADTLFQPKYLTHADAVLAMYHDQGLPVLKYEGFGRAVNITLGLPFIRTSVDHGTALELAGTKSADAGSFRTALNLAINMIQNCNE

SEQ ID NO: 6587 - protein, 72 aa, Proteus mirabilis
PSVLALFDVNRFFWNIFMSHSEHNQTRRRLIKGIGALLLLSVSPVGLAATSSVVAVRGMACIDLYTCDYRIK

SEQ ID NO: 6588 - protein, 342 aa, Proteus mirabilis
MFSIRLADLAQQLNAQLHGDGDITIAGLASMGLANGEQITFLSDSRYREKLSECQAAAVVLTEADLPFCPVAALVVKNPYLAYAQMAQIMDTTPAPAQDIHPSAVIAADAKLGNNVSIGANAVIESGVELGNNVVIGAGCFIGKKAHIGDNSRLWANVSVYHEVIIGKDCLVQSGTVIGSDGFGYANERGNWIKIPQLGSVIIGDRVEIGACTTIDRGALDNTVIGNGVIIDNQCQIAHNVIIGDNTAVAGGVIMAGSLKIGRYCMIGGASVINGHMEICDKVTVTGMGMVMRPITEPGVYSSGIPLQPNKAWRKTAALVLRIDEMQKRLKSLERQVENSDK

SEQ ID NO: 6589 - protein, 183 aa, Proteus mirabilis
SSTMKKNIRLLTHNEIPRVWEIDRTELIERLYVLQQGQLVLSEQRFDMKGWPEGEAEHYTPVLLESAERGAPFWGVFEDDKLVAAASVDPQWRGQDNTLLQLSFLHISHQQRGQGLARILFDYCVEYAKQKGASGLYISSTPSENSVNFYQHMGCRLIDVPDTELYEREPEDIHLVLNFNKED

SEQ ID NO: 6590 - protein, 318 aa, Proteus mirabilis
KGAIMIERLSPWNLGATLYMPATRTDIAATIIDQKIDGLRSLIICLEDAVSDTDIPQALQNLATLLTTLSDYKKHHDCTEWPLLFIRPRHTEMAQWLVEHVDLTVIDGLVLPKFTQASLPLWWRIIKPTHLCMMPTLETEEVFDVLQMTSLADLLLAHPCHKRIIALRIGGNDLMNVISLRRNRHLTLYDGPMGYVIKMLVAVFGARQFALTAPVCEHIDDQQIMDRELALDIANGLVGKTAIHPKQIDKIEQALMVSQSDHSDALRILNSTQAVFKSHGAMCEPATHRRWALSILTRAKLYGIIPNSKNSVQRFNTP

SEQ ID NO: 6591 - protein, 78 aa, Proteus mirabilis
MGAIICTLYFFINILIVKLGYFVKIAIYFVICSRLRMSITYITDLLEKTVLYLKFCHIERYCLMKVYVKSIKCWILFE

SEQ ID NO: 6592 - protein, 202 aa, Proteus mirabilis
IIAIRSRNGYGVLMTNYTVLLDACVMYPAPLRSYLMYLANTGLFRARWSNQIHDEWITNLLVNNPTLTAERLIRTRDLMNAHVPDCLVEGYEPLICGLKLPDPNDRHVLAAAIKGQAQAIITFNLKDFPQKYLNSFDISAIHPDEFLSDMFELNPSSCIKAAQQHRQSLKNPPMTVETFLGCLQKQKLPQFISHLRAFQILL

SEQ ID NO: 6593 - protein, 416 aa, Proteus mirabilis
SQAIKDQDPVKIYLVGGAVRDQLLNLPVKDRDWVVVGATPETLLQQGYQQVGKDFPVFLHPDTHEEYALARTERKSGSGYTGFTCYAAPDVTLEDDLQRRDLTINAIAYSAKGEYIDPYHGIDDIHAKLLRHVSDAFSEDPLRVLRVARFAARFAPLGFTIAPETMSLMQEMTNSGELNALTAERVWKETEKALHSQAPQVYFEILHQCGALKILFPEINALFGVPAPKKWHPEIDTGIHTMMVLAMVSRLTDDIAVRFSALCHDLGKGVTPVENWPHHHGHGPAGVPLVEALCQRYRIPNQIRDLAKLAAKYHDHLHRIEKMRPSKIIRLFDAIDAWRKPERIDQLAIISEADARGRQGAENLPYPQGIFFRQAFKIANQVDVKSIVSRGLKGSAIREALTKQREVAIIEWKSRL

SEQ ID NO: 6594 - protein, 1095 aa, Proteus mirabilis
CYPFQHNRRYRMNKEIALSHHPINQKKNTTNSLFQLSLITSALLFSGYAVAYSEVGQLGNKQSWESPEYQKDWGLAAMNASSAYALGFHGQGAKVGVMDSGALLSHQELSGSRFHAVKAKGEYGSTGMRYPQEMGGHYEKGQVFDVDGNWIKGVNDTHGTHVTGTVGANRDGNGMHGVAWGADIYLGNTGATDSNNYGPYQDYTYFYTGWKAMVDAGAQVINNSWGTNPRIINTDKTEGPDGGDTTIHMPVNTTAQTEYEYFYFKKVYGDKPSFVDAAYDAVKGTNVVQVFTTGNRDFAQPYYRPLYPYFNPEAEQHWIAVAGLKQNADNTGYVLEKVFNEAGNAKWWTVVAPGRNIYSTVVDEEGNPNWKVFSGTSMAAPHVTGAMGVLMSRYPSMNAIQVRDVMFTTANHRDPDGSLYESWTAAEGTPDVRYGWGTPDLDKGMYGPGQLLGKFEYNLNATPLDVWTNDISQTALDLRKQEDLAWLKEYTEKGIAAGGDYHLGTDFVINDGNPDPTSHIVSQEDAEKWRQEYYQKRADAIQAKIDAGLYDGALVKRGEGTLVMTGNNSYRGGTTVEQGTLYGFSGSFGTQAVNVNGGKLGIIERYNDTFTQKGQLTSNQNHKVNININDKGRYLVTAGHNVNIGNLVLNQGADIDVGADNVGQLKDIYLNNSVVVGEVNTDSLVDNRTKTKMLASNRVVADPATTTTVINNDYALFDKHITITDKTISGSLTKKENTTLATFADNENGRAIANALDNTGDGELFNAVLPMNENDLKTTYQSLGSDMYLNANNASIVNVLGLTRTVKDQAIGIGDGRHAQLGNSNARIWISGMGQWGKTDYGHSDMDIDFYVGLLGAEIDVTENTKAGLFFGAGSTKYKGNQYGKIDSNDIHIGAYGISNLYDVASLNYGFTHTNQDRDAKRTLWIGQTAGYNSTSYDAKISQFFLEGAYTQLNTSQYSIEPYAGFSWLRVSTDNINENVGNMKFTTKTDAQDIQVATVGLRGGYPFMAGNINMALKGDISASHLFGDNRPESRLWLSNSGEASLRGGKLDNLFGVGLGVDAQLSKSTTFGISYQGQYNSDINSSGINAILKINF

SEQ ID NO: 6595 - protein, 73 aa, Proteus mirabilis
RVQIRCAETSWNGESSMTGRRSEHSAVRGSSAVVVALVTTTSSRNQVRSPTKLIANLKAYAHRGLEKHRWRVL

SEQ ID NO: 6596 - protein, 268 aa, Proteus mirabilis
RTQMAIVIKTEEDIQKMRVAGRLAAEVLEVVAPYVKPGVSTAELDRICHQHIVDVQQAIPACLNYHGFPKSVCISVNDVICHGIPSEDKILKDGDIVNIDVTVIKEGFHGDTSKMFIVGKPTIQGERLCRITQESLYLAIKMVKPGIRLRELGKAIQKFVEGHDFSVVREYCGHGIGEGFHEEPQVLHYDADDGGVVLQKGMAFTIEPMVNTGDYRIRTMKDGWTVKTKDRGWSAQYEHTLVVTDNGCEIMTLRKEEEPFISAVLVNE

SEQ ID NO: 6597 - protein, 244 aa, Proteus mirabilis
RSKMATVSMRDMLQAGVHFGHQTRYWNPKMKPFIFGARNKVHIINLEKTVPMFNEALVELNKIASRKGKILFVGTKRSAVEAVKEAAESCDQFYVNHRWLGGMLTNWKTVRQSIKRLKDLESQSQDGTFDKLTKKEALMRSRELGKLENSLGGIKDMGGLPDALFVIDAEHEHIAIKEANNLGIPVFAIVDTNSDPDGIDYIIPGNDDAIRAVKLYLTAAATAVREGRSQDLAVQAEEGLVEAE

SEQ ID NO: 6598 - protein, 418 aa, Proteus mirabilis
QTKIWSRQMKQLTHILKPRTLVSRSIILALVSLLVACNQEKDKSLTLSTPSVLPADGSRQLYNYHDPNFAAFAQKLKQRRQRVHIVQLGDSHTAADFFSGKLRERFQADYGNGGIGFIPPTAIAGQRIANIQYQSSKKAWDLLSSRKESDPDFPLGGFIAEPVAKWSALQLNENPTTGQRYQLQALYKAPTASQIHLQSAGSKTLSLSQTQGEWQFSKPTTITFPINITISKNQPIKLGGWLISNQKPGVMLSALGINGATINMMDKWGAQWSKTLGQLHPDMVILAYGTNEAFNDTFDLVAYRQLLVEKIRQIRQQAPNSAILLVGPSDSIKNKDASDCRSQQPQWLTDIIRIQKEVAQQERTLFWDWRDYMGGECSIKAWSIYDLARPDGVHLSREGYESSANTLYSQLSALINKS

SEQ ID NO: 6599 - protein, 124 aa, Proteus mirabilis
AEKIRDDVMDIVFIEQLSVITTIGVYDWEKTIKQKLVFDIEMEWDNKRASQTDDVAHCLDYASVSHAIIEYVEKRRFELVERVAEEVAQLLITQFSVPRVKIKLAKPGAIAQAANVGVIIERYA

SEQ ID NO: 6600 - protein, 65 aa, Proteus mirabilis
LTEINAVKVPNLFSHLNTKYSCFSVIFFVPKIEDNITMSLILFVSLWLLSTSTLILIHFHPLFHK

SEQ ID NO: 6601 - protein, 154 aa, Proteus mirabilis
INEIGDIMAKIGIFVGTVYGNALAVAEEAQRILLEHKHQANIYEEGTLADWQKYSTVLVISSTTGQGDLPDTIAPLFYELRDNVGYQPNLHYGLIALGDSSYDNFCGAGMQFEALLQEHQAKRIGEILKIDSMDIAEPEVFAINWLENWATLLN

SEQ ID NO: 6602 - protein, 131 aa, Proteus mirabilis
IHEIRRIKMSFFNKLKEGFNSGRAELTKQVSRFKNKKFMQGTVAVCARIAIASDGVSSEEKQKMLGFLKASEELKVFDTSDPIEFFNKLIRSFEFDTEVGKGETMKFILGNERSARSCTISDPCRYCCCEK

SEQ ID NO: 6603 - protein, 239 aa, Proteus mirabilis
KREIRKYPELRELMMGKKLLFAAIAAGLFIMSGCQNNIGLSLDGKIVDQTYNSILPCADCSGIDTTILVNQDGSYVMEQSYQGTSDDNRSFFESGTWLLSKDKLTLTNSYGEKSYYLPREDKLVMLDIDGNVINSGLNYTLAKVQPKQLAGEFTYFADAGTFKDCQSGRVYAADGLVLEKGYFATGVDGGTPVYLEVRGYYSIRPSMEDGQYDRALVVTDNKPRFDRHGSCNSRRNSRS

SEQ ID NO: 6604 - protein, 1651 aa, Proteus mirabilis
AKEIRYTMSDIHDTNREQEILDSAVAQGGAYEILRKRLTEQGQQLHVKATELNQHRLAEFGQSQMDIIGRIRIRTENNCQARDIVRVGEWLLFGYNVFLGLKRETHLEDVFSLYRLIDNNGEFDVEAVAYEGTFLNDNRFIQDFTELYTYYKNTQLLQLVERDGKLLASFQIGDRITDVRVFRWSISSDKQRIEYIDNRGERDIALPPAYDFDWIKTQREDTVNGRFPHINILDTVFVETTGGDLTVKCENNTEDGLGIYREAVLDKNQSLDDAQIEYAQTGSLILLKVLPYREENWRYLVYNTLTQSVQRIDAIGQACVQLPEDHGIIFPGGYYLQNGDYKTFDQPMEGMYFRRLRRSPNGEDVLYVFYSPTQGRLALFNYNMIERKLATPLVGHGYAMLEDGKMVLFEGEGEEATRVHPMQVWQTPFYSEEFADKQPPRNGFYGRIGNADLVRGISEILHVAKEIEGSQVSIARYEQLSQQPKSLLDLYYWFNDEHCLGIGPLLKEIAQTSELVLDEYEKVESIRQQSAKSMQEAINRQKSLLSLTLPDSWTDIQQFVDSLNSLNTHHGHLISLREFRYMDLTQLNKMETEITEAQQRVSQATAQFLASDKALQPFKTQLTTFEQQIEKAQNSAQLDVPMNEMAQMSEDLDMLSNLMASLTFEDVTQQTQIIDAISQIYAQLNQSRARLQQKRKSQSSVETVAQFGAQFRLFSQGITNALSLATDPERCEEQLSRLLVQLEELESQFSQHDEFLDDILSKREELLETFEAHKQSLLDDRQRRSQSLLTAANRLLENLQRRTTRLQSQDELNAFFASDPLALKTREIIEKLREINDNVKADDIDARLKSSRDQAIRILRDKTDIFEEGGNVIKLGPRHRFSVNTQELDLTILPKEDKLWLYLTGTDFQEPIDHPELETLRPYWNATLSSESETVYRAEYLAYSIIYAASKRQDGLTLEILKEALSVPEKLEKLVRDFATPRYKEGYEKGIHDHDAIAILKKLLPVGESADLLRYNPTARAIAAIFWEKVQTNEYPALWPERARTAVNIQQLFHNDDALIDLQAEIEADIRLFLTDNPIKCGSYVPIQAAEYLSFALARTPIELVYSKYAKELVVALQNRLEAAHMWIDFNRSQQNLASRYAQRWALIQNWLQGLCSQADYAHLTPYIPGAIAIIMLDKIASARYSEVDLYFKVNGLLGEHPTIENQTLSLSLDDYFSRMRGQRKTFIPAFNHYLTLRQKIVLEERQRLKLDEFKAKPLSSFVRNKLINDVYLPIIGDNMAKQIGALGEGKRTDLMGLLLMISPPGYGKTTLMEYVADRLGLIFMKINGPALGHNVLSLDPEQAPNATAKQELEKLNLALEMGNNVMLYVDDIQHTHPEFLQKFISLCDGTRRIEGVWKGKTRTYDMRGKKFCVVMAGNPYTESGELFKIPDMLANRADIYNLGEVLGGMDDAFALSYIENSLTSNSVLAPLALRDLNDLYLLVDKAMGKSVSTNSLSYPYSDAEINEIVMVLKHLITLRDVILKVNQQYIASAAQSDKYRTEPAFRLQGSYRNMNKLSEKVSAVMNEKEIERLLDDHYLGEAQLLTTGAEENLLKLAEIRGTLTEQDAIRWQQIKKDFMRNKALGGDNADIGDRVVSQLANLVESVQSLR

SEQ ID NO: 6605 - protein, 479 aa, Proteus mirabilis
ITPLEPFMNFFSFEFLGAFTSFFIIYWLFQKQVKIQNILLIIVSYAFLFYVDYRPAVILLSYTLLIYSLANILTRYTSTKVIYWLLGLLVALYFTAFKYYSFFQESLTQLFSQWGLSVELPIIELLAPLGLSFYIFHSVSYVVSVCRKEIPKAPFLDVVLYLCFFPSIVAGPINRAKQFLPQIQAPTRKIIDYKGAIMLIVLAIAKLFWLSGWLSTNYVDPIFNAPDLATSGQVLVATYAYAWHIYFNFSGYTNLVTGIALLLGFVVPRNFNAPYLAINLADFWRRWHISLSTFIRDYVYIPLGGNRKGVIRQNVNAFAAMVISGLWHGAAMTFIIWGAIHGIGVVILNIKHRLFPAAKHDANSMLASLKMLLSWIITFHFVCFAWIFFRSQTVNDAWILIQQLFSAGAWQSLQAEGLTLFMFWGLFLLYPCFVTLRAIIARLEKKVPWYVYPLPLALILTIIFMLSPDGVPGFIYASF

SEQ ID NO: 6606 - protein, 557 aa, Proteus mirabilis
TERIQRKYTMAAKDVKFGIDARNKMLRGVNVLADAVKVTLGPKGRNVVLDKSFGAPVITKDGVSVAREIELEDKFENMGAQMVKEVASKANDAAGDGTTTATVLAQAIIAEGLKAVAAGMNPMDLKRGIDKAVVGAVEELKKLSVPCSDTKAIAQVGTISANSDETVGTLIAQAMEKVGKEGVITVEEGTGLEDELDVVEGMQFDRGYLSPYFINKPETGTAELENPFILLVDKKVSNIRELLPVLEGVAKANKPLLIIAEDVEGEALATLVVNNMRGIVKVAAVKAPGFGDRRKAMLQDIAILTNGTVISEEIGMELEKATLEDLGQAKRVVINKDTTTIIDGLGEQEAISGRVAQIRQQIEDATSDYDREKLQERVAKLAGGVAVIKVGAATEVEMKEKRARVDDALHATRAAVEEGVVAGGGTALVRVANALREMTGDNEEQTVGIRVALRAMEAPMRQIVANAGEEPSVVVNDVKAGQGNYGYNAATEAYGDMIEMGILDPTKVTRSALQFAASIAGLMITTEAMVTDLPKDEKMDLGAAGGMGGMGGMGGMM

SEQ ID NO: 6607 - protein, 320 aa, Proteus mirabilis
GEGMMTFQETPSFMMGIFAVIQALFLLAITPLCTGISRQIRAKMHSRQGPGIWQDYRDIFKLLKRQSVAPEQSGVIFQVMPYVLLGSMLLVAMALPVFTATSLFGGAADLIALIYLFALFRFFFSLSGLDSGSPFAGIGASRELTLGVLVEPILVLSLIVVALIVGSTNVGTISATLAQGWVSPTATLLALLACAFAAFIEMGKMPFDVAEAEQELQEGPLTEYSGSGFAMVKLGIGLKQVVIAELFLAVFIPFGKATEFTFVALLVALVLMAVKLLVVFVLASLVENSLARGRFLLTQHVTWLGFGVAALAFVFYLTGL

SEQ ID NO: 6608 - protein, 386 aa, Proteus mirabilis
GILMLTRLAVFNIIFILVISGCTTSSVSENIAAHLESETQEEASQVWQTPPALDAPNGLRPCCAFGYNLKVKAWGIPIPFYRIDNIVEASTLGDHRYNDNFWLGTAAVLGIGSEKSGIVYSHKGGFLDIAHIRDTADYTYYLFSHIYPKLGQEWTLTLSDELAQRKIHFNRFTPPSSDRQRYTLSAYLAARLAYRLAVWHEIAQWYGYRSVAGFSEGISAFSPEDLYSNLMGARLSLTLILNGDATNLEHYNQSMQRIIPSALAQLEAQPRQATQQWFDLIDGQWWNSQERVPDKFLVLKRDYHLADKRYPVLPFGETTPPHYLTLPDVYAGYSLKQLAEFQLWPTKQMANLPIPKTYWKEADFADLAEKARQIDQKTRPKTTKND

SEQ ID NO: 6609 - protein, 109 aa, Proteus mirabilis
KELMTRKIPKPNQERYRYRSGCGFFNYRLHHLVCYLKYNCLKLHLCVLFLTVFKRKWQKLHKKLASYQILSIVPLCGDAGWSSLVARRAHNPKVVGSNPAPATNSQHMQ

SEQ ID NO: 6610 - protein, 391 aa, Proteus mirabilis
DMTLSGQSSIKQRPLVIGLVAGETSGDILGAGLIRALKQMHPNIRFVGVAGPLMQAEGCEAWYEMEELAVMGIVEVLERLPRLLKIRKDLTQRFTQLKPDVFVGIDAPDFNITLEGRLKQKGLKTIHYVSPSVWAWRQKRVFKIGKATDLVLAFLPFEKAFYDKYQVPCRFIGHTMADAIALHPDKKAAREHLGIDQEAICLALLPGSRHSEVEMLSADFIKTAQRLKQQIPALHIVVPLVNAKRRAQFEQIHQSVAPKLEIQLLDGQAREAMTASDATLLASGTAALECMLTKCPMVVGYRMKPFTFWLAKKLVKTPYVSLPNLLAGREIIKELLQEECTPEALAEQLLPLLTDAEKAQHLKEIFLQLHSAIRCRADEQAANAVLELAGQ

SEQ ID NO: 6611 - protein, 296 aa, Proteus mirabilis
NPLIFRRTFTPTLIITIHIGKNMNTIETTDFAELYKNHMQQAQRTKKEPEHWDKRAEKMAENCANPNDPYLIKFREMMDFSDAETLLDVGCGPGSISIHVADKFKKIIGIDYSTGMLTVAKRRAAQAGIHHADFLHYSWEDNWDALPPCDIAVASRSTLVMDLKAALLKLNRQAKLRVYTTHTVSPTFVDQRILRLLGRNVPTLPTYIYAVNILNQMGIHPKVDYIRSHNCQNNFNSLEQFIDSINFSVGPLNENEIAHLTTYYHESMKNDVALISPTRDWAMVSWDVVPESELTL

SEQ ID NO: 6612 - protein, 883 aa, Proteus mirabilis
LTMITSNTFQTAPPSPSLLTENTLDSTLLKHSIEQFQSWLTDAFHHDADVALLLQARSHFIDQLLTQLWRYTELADHPDLCIIAVGGYGRQELHPLSDIDLLFLSQQPLPPQIAEKVSQLITLLWDIRLEIGVSVRTMEECLLEGLSDLTIATNLLEARLVCGNNALYQQLIKHIFSQGFWPSPDFFAAKIDEQEQRHQRFHSTSYNLEPDIKSSPGGLRDIHTLIWVAHRHFGATSISEMVNFGFLTPAEGQELLECQYTLWKIRFALHLVLNRYDNRLLFDRQLSVAQLLNYQGEGNQPVEKMMKDYYRVTRRVSELNDMLLQLFDEAILALQPNVKPRPLDKEFQLRGTLIDVIDDECFLNDPIAIMRLFLRMAEHAEITGIYSTTLRHLRYARRHLVQPLCEYPLARQVFMQILRHPRAVSGAFVPMHKHSVLSAYFPQWNNIVGQMQFDLFHAYTVDEHTIRVLQKLESFADDANRNRHPLCVDIYPKLPQIELLRLAALFHDIAKGRHGDHSLLGAQDVISFAQQHGLNQREIALVEWLVSHHLLMSVTAQRRDIQDPDVIFQFASEVKNESRLRYLLCLTVADICATNSSLWNSWKQSLLRELFLATANQLRQGMHSIPDLRERIRDHRQQALTILQQQQVDEEKLQAIWARCHADYFLRHTPEQIAWHAQALIEHNSAEPMVLISQQTEHGGTEVFIWCADRPSLFASVAGELDRRNLNIHNAQIFTNRDNMAMDTFIVLEPNGKPLAIDRYHAIRQALIRVVSAPYNANAKTRALPAKLRHFEVPTKINFIASNHNKRTYMELFARDRPGLLAIIGKVFADLSLSLHGARITTIGERVEDFFVLTDNENNALNQKMKDEVVERLTKALVSKDKI

SEQ ID NO: 6613 - protein, 91 aa, Proteus mirabilis
ENMMASGWANESAVQEQIDATIDDAIARARNQMTQGESAEFCDECGEAIPLARQKAIRGVRYCINCQEAIDKKYNTFSGYNRRGSKDSQLR

SEQ ID NO: 6614 - protein, 176 aa, Proteus mirabilis
LTMINIHTLGPAGTNCEKAAYYWLNKNNQQGNIILHPTLETAVKEMEVSQNSILLGCIVYPFLHNIVFNNLSFIKLTDCFVMDTHNMLFASRFNNIKEIKKLGSHPAPQDLFRKITELDNIERVLFNSNSEAALQCGLGRVDGCITTLSAAKKYHLNILYDFGPVPMGFSIHSKLN

SEQ ID NO: 6615 - protein, 484 aa, Proteus mirabilis
GAMIAMENIALATLLIPFAGALITSILPNRMAKWLCTLFALLATLGTVVLGWQFLAEGKVDTTITLVQYGDVALFGFTIDRVSTLIAFAVVFLGLLVSFYSTGYLTNGNREHPHDGTRRYYAFLLIFIGAMAGLVLSSTILGQLLFFEITGGCSWALIGYYQSEKSLRSAMKALLITHVASIGLYLAAATLFVSTGSFELTAIATLDEPTKLIVFGGILFAAWGKSAQLPLQAWLPDAMEAPTPVSAYLHAASMVKVGVYIFARAIISAGDVPHIIGWVGIAMAVITLIYGFMMYLPQKDMKRLLAWSTITQLSYIFLALSISIFGPREAFNGGVAYIFNHAFAKSLFFLVAGALSYSCGTRMLPRLKGLINKYPLLGVGFCVAALAIAGVPPLNGFFSKFPIFAAGFELSSVFWVMTPIMVLVLIESVASFTWFIYWFGRVVPGEPSKEVAQGQPVPMAMQIVIGILIIMSFASSVIAVTWLG

SEQ ID NO: 6616 - protein, 156 aa, Proteus mirabilis
GVAMTYDELYQYAIFMLSRRDYGTTELKRRLARRINEVDKAKQSTTDERCLEQVIERLLEGQYLDDNRTVYAFFRRYLSKSYGPLRIRQELQQKGFPSEIIARVLEETETDWYALCQDLKEKKFGTGKPKDFKERAKQIRYLQYRGFTSDYINALF

SEQ ID NO: 6617 - protein, 792 aa, Proteus mirabilis
WMQILMPKQSGKLGRRLYLAFIFSSLLTLLIGGVIFFMWGKLATQINASVGDSLPMLTTSYNMERYSTNLQMLLKEREQTQRKSVSEQQKQQIYQLLDNLREFPIEQQSQRTFYNQLVDDLSNLIEQQDILLDKRRELENRLAQLLGQLAWMHDAVGEDIKPLLNEIEWHVSQMLNEKNVQENSLQLLLESTLLQELFTTENELISLVEEIAHQRYSRDIDVAFHYISVKIDEIIALNQKLKSYPSTIAHRQVLQEIIAITRFDGDIYQTLIDDVETEKKLKALTPKLNEKLSQFDNAVRSNVLATSEALNKLNDNTRQLMATGKIVIILIVVASLLLSIIVMKILIDRRLIARLNKLSDDLAHVAKGHLTEPVLIEGQDEIGLLSRRLRRFWRQMKEVEATNALNLINNTDASLITCHHDGRMETVNPSAATLLGIGHEQSNKPLWLLFSGEANTILRAQFSPTSPLYLFGQSESIVSMVKQGKPHFLQFNIREYPHKDEHKYIVTITDITRQELSRLELKHLVALKTQDLQEKNQQLNEEIVRREQAQKHLIQTQEELVQAAKMAVVGQAMTSLAHELNQPLSAINTYLYSVKLTLQMEKYDQLPDPIERIEKLCARMNRIITALRNFSKKSSSEVSYVSAPLQGLVESAMVLVESRSKREQCTIINNIPSELNICADPTQIEQVLVNLFVNAMDAVAGMGESQISVDLLSDEAKYQRVAITDSGKGFNADVLPKLFTPFTTTKDVGLGLGLSICRSIMQRFGYEIYLASALNGGAMVVLEFTHDTVTAV

SEQ ID NO: 6618 - protein, 352 aa, Proteus mirabilis
KVKIMSNDISVYTEGINDLPHLNTRVNTDNYFENLLEDEDFLSWEPNREYQDMNYDNNRKNKFIEKLPDTDKYYYLDDDYNKTINDKNNFLNQFSNDLNDLRKKDNSYETDSLSDLFNNVKQSIVSGKADYLDVLKDIFSNYMNFVNELRQTISNLNKYQKAGSKEGTVNFDFKSFFNDLSNIRDKYKNPTGTVDDPFVFKSRLFFQHQKDGTYLRTIDGQEVHYSDLQQVNNAADALEKLLKGINGISVSIQRRGGEPDVDIDCRGRIDCTDLEKLLNDLSKKVSNTDDINQTEFELFRKTIDALDKKINTNLDELSKKYSTANSNYDNFVKIVSSTMNTLLEMAKGFLRF

SEQ ID NO: 6619 - protein, 474 aa, Proteus mirabilis
NSKIGFYLPFPLKKNKNTLNANKNSLERGFMKERSTELVDGFRHSVPYINAHRGKTFVIMLGGEAIAHENFPSIINDIGLLHSLGIRLVVVYGARPQIDVALEEQKISPLYHKHTRITDSKTLEVVKQSAGTLQLDITARLSMSLSNTPLQGAHINVVSGNFVIAQPLGVDDGVDYCHSGKIRRIDEEAIHRQLDNHAIVLIGPVAVSVTGESFNLTSEEVATQLAIKLKAQKLIGFCSSQGVVDASGQIVSELLPNQAEERIQALQTTGDYHSGTVRFLRGAVTACRRGVERSHLLSYQADGAIVQELFSRDGIGTQIVMESAEKVRRANINDIGGILELIRPLEQQGILVRRSREQLEMEIDQFTIIERDNLTIACAALYPYQSEKIGEMACVAVHPDYRSSCRGEVLLQRISTQAKQMGLDKLFVLTTRSIHWFQEKGFTPAEIDKLPIEKQALYNYQRRSKILILDLHKE

SEQ ID NO: 6620 - protein, 195 aa, Proteus mirabilis
FKEISVQREALLDHVLIQLEQHGLAATLPELLQGFDITESELQPFWPDKDALIFDCLRHHGQQIDIWQRQVILDETLTTEQKLLARYDQLAMRLEKNRFPGCLFVAACSAYPDEHSQIHQLSQRQKQSSFEYSRMLLRKLDLEDSELVAKQMELILEGCLSRLMVNRRADDITTAKLLAQDILKIAQCRKNGALS

SEQ ID NO: 6621 - protein, 403 aa, Proteus mirabilis
IFRIFMNKSIIIILLVTVLDAIGIGLIMPVLPTLLNEFVSENRLANHYGILLALYATMQVIFAPILGKLSDKYGRKPILLFSLLGAALDYLLMACSTSLWMLYIGRIIAGITGATGAVCASAMTDVTHPHERTRYFGFLGGAFGVGLIIGPMLGGLLGEISAHTPFIFAAISHSLLFIFSLLCFQETQTTKISTEISALNQDTTPHSATGFIKKSLCFWLIAYFIIQLIGQIPATIWVLFTQVRFAWHTTEVGLSLAFLGVLHIFFQAVLAGKLAQKWGERNTVIISMSIDAFGCLLLAWISHVWVMLPALICLAAGGMGQPALQGYLSKSVDHHVQGQLQGTLVSLTNITGIVGPLLFSFIYSYSVEYWDGLLWFIGAMLYSGLLVACYFKQKSPILKKFPS

SEQ ID NO: 6622 - protein, 332 aa, Proteus mirabilis
RRYLEVDLSVIRQTVGFFLRLLCLLLVTTAGVFILLSFSPIDPIKAYIGSDLLNVPPEQYPLIAARWGMEQPLWMRFWLWFSQIIQGDFGYSMLYNMPVIDVIRQRAGPSFILLFSAWLFSGVIGVLMGLVAGRYLNRWPDRIISTLSYLLASLPTFWVGLLLLSLFSVTLHWAPICCAWPMGSSAEAATLGQRFSHLILPMIALGLLGTGNIALHTRAKVAEVMGSEFIHFAKAQGDKGWAMMLFHVLRHAITPALCLQFASIGELLGGSLLAEKVFAYPGLGQATVDAGLRGDIPLLMGIVVFSTILIFFGNSISNYLLRRINKGILRDL

SEQ ID NO: 6623 - protein, 276 aa, Proteus mirabilis
YKIVMNNRVHQGHFARKRFGQNFLTDSYIIESIVESIYPQPGEAVIEIGPGLGALTEPVGERMDKMTVVEIDRDLAARLEVHPTLKDKLTIIQQDAMTIDFAQLAKERQQPLRVFGNLPYNISTPLMFHLFSFADAISDMTFMLQKEVVNRLVASHGSKTYGRLSVMAQYHCQVIPIIEVPPSSFKPAPKVDSAVVRLIPYKEKPYPVTDIAMLSRITSQAFNQRRKTLRNSLGGLLTAEDMLALDIDPTARAENISVEQYCKVANWLSSQQQHAE

SEQ ID NO: 6624 - protein, 275 aa, Proteus mirabilis
SLAVTGISAAELWQKIIPVQIIGIFGSMLFAAVMGVRETKRIAKAKLKGTTPYEQDSLLRQFDEDQPETGTEKPQKFWINLLLIIGSITCLALGLFSAPYIFMVALSAALVINYPKPKDQIAIINHHAPQALSMVAIILAAGAFLGIMSNGKMLEAIALDLAAVLPSHWVDNLHIVVGILGVPMDIFTSTDAYYFALLPIVQEVTASGGVHVADVVYAMAIGNNAGTFVSPFSPAAWLAMGLAGTDMGKHLRYSFGWIWLFSFFTLGVGTLLGLF

SEQ ID NO: 6625 - protein, 323 aa, Proteus mirabilis
NRNVMSLNFLDFEQPIAELEAKIDSLTAVSQHDEKIDINIDEEVARLREKSLELTRKIFSDLGAWQVAQLARHPLRPYTLDYINRVFTDFQELAGDRAYADDKAIVGGIARLDGRPVMIIGHQKGRETKEKIRRNFGMPAPEGYRKALRLMEMAQRFKLPIITFIDTPGAYPGVGAEERGQSEAIARNLREMSRFGVPIICTVIGEGGSGGALAIGVGDKVNMLQYSTYSVISPEGCASILWKSADKAPLAAEAMGITANRLKELKLIDTVIPEPLGGAHRHYDEMAASLKAQLKADLAQLDEFDTEELTNRRYQRLMEYGYC

SEQ ID NO: 6626 - protein, 250 aa, Proteus mirabilis
LICLGQNTMATNAKPVYQRILLKLSGEALQGAEGFGIDASVLDRMAQEIKELVELGIQVGVVIGGGNLFRGAGLAAAGMNRVVGDHMGMLATVMNGLAMRDALHRAYVNARLMSAFPLNGVCDNYSWAEAISLLRHGRVVIFSAGTGNPFFTTDSAACLRGIEIEADVVLKATKVDGVFSADPTKDPDAVLYEKLTYQDVLERELKVMDLAAFTLARDHNLPIRVFNMNKPGALRRVVMGESEGTLISHA

SEQ ID NO: 6627 - protein, 162 aa, Proteus mirabilis
LDSVLLDRKSIAMSDNHTLQIEEILDLLPHRYPFLLVDRVLDFEEGKFLRAVKNVSFNEPFFQGHFPGKPIFPGVLILEAMAQATGILAFKSVGKLEPGELYYFAAIDGARFKRPVLPGDQMVLEVEFIKERRGVARFKGVAKVDGEIACEAEMMCARRREV

SEQ ID NO: 6628 - protein, 287 aa, Proteus mirabilis
CSPVSVLMTLTIYCLMDTIGVKSFSVFMTKFDFHVFNIKINSLSFYKVQTMNEQNFLANYNRRDFLSPLITVDSVLFTYHEGQLKVLLVERANHPEKGKWGLPGGFVDETQDNCLEDTVLRKLKEKTGVIPPYIEQLCSVGNNQRDVRGWSVTVCYTALIAHQACKAHIDSVDHVMWLPIDEVAQKNLAFDHNELIAQARERLKQKSLYSIVPGFALPEVFTLPELQHVHEILIGKEIQKKSFRRRIEQADLLIDTGEKRAEKGRPASLYRLKKSSADYRFIRNLEF

SEQ ID NO: 6629 - protein, 522 aa, Proteus mirabilis
EHTVRTPLMICALMTSFSSFANCLSITENKEISGQFNHDKALCFTTHLQSQRYAELDVKGIQNLQLANQDGTHIRRLLKDVPVDGQQQKIRFLLPETANYQFIAQGEVGVQWHITLKTYPYQPLDKDAGIALTSPRLQMLAQDLTASNIQLFWQQIQQEGTPLVEPYDNHNKRVTFLWQGAQSNVYLLGSPAGDHDPLTRLANSDIWYRSYIVPNDTLMQYKLAPDVPVIENATAAQQRRAILTTAQADPFNLHPSPSKADDRYNYFSLLSLDYPRECQLPDILDRAMNGNTSISRFHSEILNNDREIALYLPAQKMTTPRLLVLFDGQIYRQQYGIDRFFDKLIEEGKLPPIAILFVDSIDSDRRSVELPPNPDFHRFLADELLVWLEQEKGLQVAAKETIVSGSSYGGLASAWVAFNRPDRFGKVLSMSGSYWWAPENEAPEWLIRQYQQADKKPLQFFLEAGLFESREGAGGILNNNRQLKQVLQQRGYPVQSLEMASGHDYISWCEALYIGTKALTND

SEQ ID NO: 6630 - protein, 194 aa, Proteus mirabilis
AEKVSTIKNFKRTVLLAMMVYAVNCQSANNGTLNFSANVTRGTCEFSDSNELSKHVSFEQFFTIGDAEDTPIKAPIKGSLGTKQFTYLIDCKEYEPDSEKKITINVKTGANTEYSDQVFYGKGDTTQTGFLVKGCLEGENASCQILENNKKLSFSSHSNSAISINYIVDFVRRNNNKMTPGDSTATILFEYIQD

SEQ ID NO: 6631 - protein, 548 aa, Proteus mirabilis
NRRVNTVRLRYKWHYPTIPELTAKAWDNSLMDVIGRQHLRQMWDDLAEVYDKKTALIFESAQGKVRQFSYSELNEEINRAANLFHACGIKKGDHVALHLDNCPEFFFCWFGLAKIGAVMVPINARFMYEESAWIINHCQAHFVVTSDNFSPIYQPMLHNKHSPLTQLFLITENGLPTEKGVVDFLSEKAKHPVTLNHHTPLSVDDTAEILFTSGTTSQPKGVVITHYNLRFAGYYSSWQNALREDDIYLTVMPAFHIDCQCTASLPAFSVGATFVLLEKYSARAFWKQILKYQATVTECIPMMMRTLMAQPISPDEKQHKLREVMFYLNLADEEKDAFIERFNVRLLTSYGMTETIVGLIGDRPGDKRRWPSIGRPGFCYQAQIRDKQNQQVPNGVVGEICVKGEPGKTLFKEYYNRPDATEKALEPDGWLHTGDYGYRDDEGFFYFVDRSCNMIKRGGENVSCIEIENIIASHPKIQDVAVIGVPDDIRDEAIKAFVVLVDGETLSEEAFFAFCEQNMAKFKVPSAVEFKQGLPRNCSGKVIKKHLQ

SEQ ID NO: 6632 - protein, 179 aa, Proteus mirabilis
GSLVIDDDGYRPNVGIVICNRQGQVLWARRYGQHSWQFPQGGINPGESPEQAMYRELFEEVGLSRKDVKILASTRNWLRYKLPKRLVRWDTKPVCIGQKQRWFLLQLTSNDKDINVQQSKTPEFDGWRWVSYWYPVRQVVSFKRDVYRRVMKEFAPVVMPLQEQVSMSRPSYGYRRKRY

SEQ ID NO: 6633 - protein, 251 aa, Proteus mirabilis
LIMVHLLIIDALNLIRRIHAASGSSCLTVCEHSVNQLLNHTRPTHAVAVFDEDDRENSWRHQLLPEYKAGRSPMPADLHQQLPEIKAMLLNLGIKSWHSGGDEADDVAATLATKVAQAGHNVTIISTDKGYCQLLSPAIRIRDYFQKRWLDLEFINQEFGVKPTQLTDYWGLTGVSSSKVSGVPGIGPKSATELLQLYPNLESLYQHIDEVPKKWQTKLSDNKEVAFISRQITTLRTDIKLNGNLQQLRLK

SEQ ID NO: 6634 - protein, 491 aa, Proteus mirabilis
QVMVLFRLIFENNVEYGMKVTLPDFNKANVLVVGDVMLDRYWYGPTSRISPEAPVPVVKVDTIEERPGGAANVAMNIASLGANSRLVGLTGIDEAAKALSNTLSQVNVRCDFVSIATHPTITKLRVLSRNQQLIRLDFEEGFSNVSPEPIYERIQQALPSMGALILSDYAKGALSHVQQMIQLAKKAGVPVLIDPKGSDFERYRGATLLTPNMSEFEQVVGVCHTDDELVEKGTQLVKDLALDALLITRSERGMSLLQANEAPLHLPTQAQEVYDVTGAGDTVIGVLATALAAGKPLAEACFLANAAAGVVVGKLGTSTVSPIELENAIRGRADNGFGIMEESQLKQAVALARQRGERIVMTNGCFDILHAGHVSYLANARKLGDRLIVAVNSDASTKRLKGESRPVNPLEQRMTVLGALGAVDWVVAFEEDTPQRLIASVLPDILVKGGDYKPEDIAGSKEVWAAGGEVKVLNFEDGISTTNIINAIKKK

SEQ ID NO: 6635 - protein, 117 aa, Proteus mirabilis
RFSVMSEGMIYLLISGIWETLVMTFVSGFFGFVIGLPLGVLLYVTRPEQIMANSPAYKVISALVNIFRAIPFIILLVWMIPFTRMVVGTSICLQAAIVPLTVGTATFICTYCKKIPY

SEQ ID NO: 6636 - protein, 518 aa, Proteus mirabilis
VAEVVMTEQSVIQRCQQIVENPTLSPEQKRHFLALEAENMLPYPTLSNEASLALNERVICDMYEGHAPYKPRYVLPDYAKFLAQGSRYLELEPAQDFDDALNMLTILYHHVPSVTSMPVYLGRIDKILLPYVGNLTQEQLYPKLKRFWRYLDRTLPDAFMHANIGPEDSIITRLILKVDVELQQVAPNLTFIYDAALTPSDLLHQAITNICHSSKPHIANGTLQDAVFGKDEYGIVSCYNSLPQSGGGSTLVRINLKEVAKRSQNSADFLENVLPFYMQKQIEIINARCEFLYEKSNFFQQSFLVEEGLISPDRFAPMFGIYGMAEAVSLLLEKEGHTANYGHSEAANKLSYIISEKLAQFVAQTPVKYGWKQRAMLHAQSGISSDIGTTPATRIPYGTEPDPVTHLMTVAPHHQFYTSGISDILTVDETIKQNPDALMQLCLGAFSCGLREFTANVGGNDLVRVTGYMVRLSDLKKYKEEGSRLNTTWLGDEATTNCHIAERKPRVISHEQQMRFDK

SEQ ID NO: 6637 - protein, 445 aa, Proteus mirabilis
HQEVAVFLAQEIIRKKRDGHPLTEEEIRFFINGVRDNTVSEGQIAALAMTIYFHDMTMPERVALTLAMRDSGTVLNWKSLNLNGPIVDKHSTGGVGDVTSLMLGPMVAACGGYVPMISGRGLGHTGGTLDKLEAIPGFDIFPDDEKFRDIIRHVGVAIIGQTNSLAPADKRFYATRDITATVDSIPLITASILGKKLAEGLDALVMDVKVGSGAFMPTYQKSEELAESIVQVANGAGCQTTALLTDMNEVLASSAGNAVEVREAVQFLTGEYRNPRLFEVTMALCVEMLVSGRLADSRQQARQKLQDVLDNGKAAEVFARMVAAQNGPTDFVENYNKYLPTAVLSKPVFAEKAGFVTEMDTRALGMSVVTLGGGRRKATDAIDYSVGLSEIAALGTEINTDTPLAMIHANSEKSWQEAAAEVRKAMVIGETKRETSPMVYRQVSE

SEQ ID NO: 6638 - protein, 646 aa, Proteus mirabilis
TRWVRTIQMIKLLEQAIAQNLLRPLDLRFAQMLVADENPILLFIFAYLSAQTGAGHVCLPLNIIQQDKLFDGRHTELSQAIWQKMAQPSAKEILAELNQSECVNQGHSDLPSPIILDNGLLYLQRMWRYEEQIAQFFRQEQRVVDIDENQLTNVLNQLFPSVKTHAETNWQKVAAAVAITSPISIISGGPGTGKTTTVAKILAAFVMLTANEKPIIQLAAPTGKAAARLTESLGKALAQLALSEEELKWMPDQAQTIHRLLGAQPESQQVRYHRDNPLQLDILVIDEASMVDLPMMARLIEALPEHCHVIFLGDKDQLASVEAGAVLGDICRFADQGFSQRRFEQIDRLTQGELQKDPASMTTSTKPVSVVSDSLCLLRKSYRFGSHSGIGQLAFAVNQGQVKSAMTLLKKATVTQESTEREKHTDPQDIEFISLDTDESYMKMLQDVAKAYHHYLSLVAQKAAPETILHSFNQYRLLCALREGPFGVTGLNERIEMLLHRQRLIRRPINSYQREYIGRPIMIQRNDSTLGLFNGDIGIMLNNDEGEMKAFFQLPDGTLKAIQPSRLPQHETAYVMTVHKSQGSEFTHTALVLPTQFSPIVSRELLYTAITRAKQKLSLYSSEYMVKMAIQTRIQRRSGLVEKLRY

SEQ ID NO: 6639 - protein, 114 aa, Proteus mirabilis
EVRVLFTAKYCKRMRGIFMDEYDHTLVSLVVVGAFIALGKMLVANEVITLRLFIGRIILGSAVSVVAGALLILWPGIHPIAVMGIGSALGIAGYQLVEIWLRKKGNELFSRKKN

SEQ ID NO: 6640 - protein, 83 aa, Proteus mirabilis
LFLFIDIVILVSLFILKIEDVLFKTLISFNKHNDFTIDVFPIPFRPVIQIKFLLEKSKSNKTLLMCCNDLMFSDINITNHLYF

SEQ ID NO: 6641 - protein, 80 aa, Proteus mirabilis
LILLFFMSLALTELAPSPLVKVILSGTTISHVLARKTTEKLYFTDCAATEAQLVNNKQRLTINIDTFFVCIINPEYIQIK

SEQ ID NO: 6642 - protein, 75 aa, Proteus mirabilis
APIFSNLSSNSISRATETPSLVITGAPKDLSKTTLRPLGPKVTLTASARTLTPRNILLRASIPNLTSLAAIVYFL

SEQ ID NO: 6643 - protein, 209 aa, Proteus mirabilis
KNVLLLSIGTISGYSVYAIGALEPGNYSLARDHSLQFNVAISSGFSIDARPYFSDSSTKITVHTLKACDVTPQTATSINYRSQIAQNFATPTKLDENIASINVDCPYAGNVHITLRPFNTLVKGSNTGMELTGTKAQESGYVVTSLTSQQQNTICEPNSSDALSYVGSNKLVNAMPKVFNQTLYFNLCANSNIPADRYSGSVDVAILVE

SEQ ID NO: 6644 - protein, 271 aa, Proteus mirabilis
MLSFLRGRKKNIIQIVIFCLFFLSYSVTSKAVEKIENDTVDLTDFGKNGFSFVVKRYIYLESDIKGISISLKNNNNSAYLINSSILFNDDDKNVPIVNKDRERTPFMILPPLYRLEPSSEYSWNIRRISEGSNDMALPKDRESLFWIAFRAVPLKDSKIEEKKSVSLTITPTFFFKLIYRPESIMALENKDVIDDVIVEKVNENIVINNKSPLYMTFEYLKVGEVEIKNDGRAITVKPFSTVSVEAPKNVQGKLSWRFNDENFFIIKDKEY

SEQ ID NO: 6645 - protein, 453 aa, Proteus mirabilis
HNPLNSSITDNAMELKNCPLINEIKRQIGSHSHILVGFSGGVDSTVLLHGLVCLRDKYQLPLELTAIYVHHGLNSKADDWLTHCEHFCHNWQVSFISERVQVNGKEGGIEQGAREARYQAYRQYLQPNQVLVTAQHQDDQAETFLLALKRGSGPAGLSSMPAKMPFEQGYLLRPLLNITREQIEAYAHEHGLLWIEDDSNQDDRYDRNFLRLHVMPLLTQRWPHFSQAVTRSAALCGEQEALLDELLDVELQQLIDEHQSLDINLLSRCSEIKRNALLRRWFAKCNKSMPSRSQLSRLWQEVALAKADAEPRLRFFQDEVRRYQQRLYLVPVMEELTDRVIEWSLSQPLILPNQLGILAVSRDSGKTICRAPLADEKVTVRFGLTASSLRIVGRDLARSSKKIWQELNIAPWQRTRIPLIYYNDTLIAAVNTFVTLEGNATTEQSITIEWQAS

SEQ ID NO: 6646 - protein, 274 aa, Proteus mirabilis
MQALQSIIDNAFEQRAEITPDNVEPQVRDAINNVIAQLDSGKLRVAEKINGQWVTHQWLKKAVLLSFRISHNQVIDGSESRYFDKVPMKFANYDQARFEKEGFRVVPPAAVRQGAYIARNTVLMPSYVNIGAYVDEGSMVDTWATVGSCAQIGKNVHLSGGVGIGGVLEPLQANPTIIEDNCFIGARSEIVEGVIVEEGSVISMGVYIGQSTKIYDRETGEIHYGRVPAGSVVVSGNLPSKDGRYSLYCAVIVKKVDAKTRGKVGINELLRTID

SEQ ID NO: 6647 - protein, 414 aa, Proteus mirabilis
SLQLYLCCLLMGFRDLFMPAFDFSSNLKKTVKVALMVLFSTLFLIWLNQTSLERFWQQQYHRPAPWSGLSQYYAWQVGGQLRDGVFVAVTSYSDYLRVNHPDNQAKPITPRQEQTAFPEGFAVGLHFINGYTRPASQLTQQFPQLLQRQYAQGTLANASTIDLTKAAAEAQKPIVQKTDVILSPKDKVLFAGDSMMQGVAPLLKRQLQTDYNISSIDLSKQSTGLAYPKFFNWPQTIANRLASDDSIKLLVVFLGPNDPWDMPPDGGGRYLKFASEAWGTLYRARIASIIDNARQHNVSVIWIGPPNMRKQKLSQGMAYLNQLYREEAEKTGEIYLSVNDMFKYEKDIYSDYIGDGSSRVKLRAGDGIHFSLKGQQIIAQQVFSRIHLQKVDDVPDDVTDKNMVTPNETINAHP

SEQ ID NO: 6648 - protein, 212 aa, Proteus mirabilis
NHKLLAVIPNCQFIQHSRSFDMAVSLVKGGNVSLTKEAPTMTVAMVGLGWDARVTDGAEFDLDASVFMVGEDGKVLSDASFIFFNNKVSQCGSVEHQGDNRTGEGEGDDEQVKITLSKVPAEVKKLVFAVTIYDAENRKQNFGMVSNSFMRVYNNDNNTEIARFDLSEDASTETGMIFGELYRHGSDWKFKAVGQGFAGGLGALAAQHGVNI

SEQ ID NO: 6649 - protein, 60 aa, Proteus mirabilis
AFSSLCRISQGIVDDAIKAYRISIFKNAINWRFLFIASYIVTIRMKFLFKPKIWIKTAVH

SEQ ID NO: 6650 - protein, 786 aa, Proteus mirabilis
PLLSVGKYIMNESLSRIIAQELSVKPQQVLSAITLLDEGNTVPFVARYRKEVTGGLDDTQLRQLETRLSYLRELNDRRQTILKSIEEQGKLTEELRSSINETQSKTELEDLYLPYKPKRRTRGQIAIENGLEPLADLLWNEPQHTPEDAASAYINPEKGIDDSKAALDGARYILMERFAEDAGLLAKVRQYLWKNAHLVSKVVDGKEAEGAKFSDYFDTHEPIAHVPSHRALAMFRGRNEGILQLSLNPDPQFEEAPKESYGEQLITEHLGLRLNNQPADSWRKAVVSWTWRIKVLMHLETELMGQLREKAEDEAINVFARNLKDLLMAAPAGMRATMGLDPGLRTGVKVAVVDSTGKLIATDTIYPHTGQADKAAASVAALCIKHNVELVAIGNGTASRETERFFADTVKRYPEVKAQKVIVSEAGASVYSASELAAKEFPDLDVSLRGAVSIARRLQDPLAELVKIDPKSIGVGQYQHDVSQILLAKKLDTVVEDCVNGVGVDLNTASVPLLTRVAGLSQSIAQNIIAWRDENGRFVDRKQLLKVARLGPKAFEQCAGFLRIRDGKNPLDASTVHPEAYPIVENILQSIHQKIDQVMGNSALLSQINAREFVTEQFGLPTINDILKELAKPGRDPRPEFKTATFAEGVETMNDLVSGMILEGTVTNVTNFGAFVDIGVHQDGLVHISSLSDRFVEDPHTVVKTGDIVKVKVLEVDLPRKRIALTMRLDEVAADSDHKRQSVTKDNASKHSRGQKPTRNRQSNTGNNAGNSAMSDALAAAFGKKR

SEQ ID NO: 6651 - protein, 69 aa, Proteus mirabilis
LISSLFNVNALLILSHLFLCIIFTLFLLCHKTVTIKTFNCHLTDLLSVRTVTEVDRCRKVILPIPQEGL

SEQ ID NO: 6652 - protein, 284 aa, Proteus mirabilis
PAISCYCYQHSEHPCKIREESITMNKLYWQTLGEGKTHLVLLHGWGLNAQVWQSIITRLSSHFTLHLVDLPGYGRSQGFPVLTLKEMADIVFSQAPEKKAIWLGWSLGGLVASRIALDNPNNVRALITVASSPCFAAHETWPGIKPDVLKGFEQQLSDNFHRTVERFLALQTLGTQSAREDTKALKAVVLAQPLPSVETLNGGLEILRTEDLREQLTTLCCPFIRLYGYLDGLVPRKVAALLDARYPDSPSVIFRHAAHAPFISHPDEFSETLLKQCEALSILA

SEQ ID NO: 6653 - protein, 279 aa, Proteus mirabilis
IWISFMKTDNYQIGIEININHINAVLVFQQNKQWKINAFWQFPLPLNDNIDDINLRTILKRWQQSLPPINRIALALPDTVASYHTIALSNLISLTPAAYYRLAQLRATSHQQVTKQAVQFDYRQHNQHLAIHLHNKTLIETYIALFAKINLTITAIDIPACALRYVATHLNISPHSILIFCQNNQMLWVCADKEMPHYGTLSYQDHQEQEKQLQQLLIKHHWPQEQCYFSGDNAEYFRQQMPIWPTQKERLFMSIPPKKTLPLIAIGLALRPWETACIK

SEQ ID NO: 6654 - protein, 224 aa, Proteus mirabilis
RDKSHGVIEYKTALEINMSYTLPALPYAYDALEPHFDERTMEIHHTKHHQTYVNNTNTALEKLPELAGLEIDELVKNLHKVPADQRTFVRNNAGGHSNHTFFWKGLKLGTQLHGSLKDAIERDFGSVDAFKELFEKAAASRFGSGWAWLVLKDDGKLAVVSTANQDSPLMGEELAGASGYPIIGLDVWEHAYYLKYQNRRPDYIKAFWSVVNWDEAQKRYQSKA

SEQ ID NO: 6655 - protein, 101 aa, Proteus mirabilis
SMKSRWGISTLLLFVTTFSVQATTSQTCRVYFKEADKFLQYIATRDDLKQNMPEIKGNFEQNKKLISSSTLKEQKAICEKGMQELDNLNKMFGPKEATAKK

SEQ ID NO: 6656 - protein, 107 aa, Proteus mirabilis
LMKSNMISGHVGIFLRKARKEKNMTGKQLARLMNVSQQQISRYEIGATAITVDQLANFLLILDKKWVDVFKYLENEFSDEREINKVDNKKKYILWKGCQTKNFINNF

SEQ ID NO: 6657 - protein, 446 aa, Proteus mirabilis
MNRSGSLSSFLEEVEKYNAHQPEYHQAVREVFTTLWPFLEKNPQYREQSLLERLVEPERIIQFRVCWLDDKGQVQVNRAWRVQFNSAIGPYKGGMRFHPSVNLSILKFLGFEQTFKNALTTLPMGGAKGGSDFNPKGRSHAEVMRFCQALMTELYRHLGADTDVPAGDIGVGAREVGFMAGMMKKLSNSNECVFTGKGLSFGGSLIRPEATGYGLVYFTNAMLKRHGMSLDGMRVAVSGAGNVAQFTIEKCLELGAKVVTASDSGGTVVDEAGFTTEKLARLTEIKNNYGRIEEYAKEFGLTYLEGQQPWAVAVDIALPCATQNELDLDAAKVLIKNGVKAVAEGANMPTTIAATDAFIEAGVLFAPGKAANAGGVATSGLEMAQNAARLSWKAEKVDARLHHIMLDIHHACVNYGGEGKQTNYIQGANIAGFVKVADAMLAQGVL

SEQ ID NO: 6658 - protein, 164 aa, Proteus mirabilis
LNLLSFFYKHIFGVNQEYSMIALIQRVTQAKVDIAGVTVGAINHGLLVLLGVEKDDNQQKAKRLCEKVCGYRIFSDENDKMNLNVQQAGGSLLVVSQFTLAAETQKGMRPGFSNGAPPEMAENLYHYFVEQCKQQGLETQTGQFAADMQVTLTNDGPVTFWLQV

SEQ ID NO: 6659 - protein, 88 aa, Proteus mirabilis
KTYPRLAIDLFGESKMIIPWQELSTETLDNLIESFVLREGTDYGMQEKTLEQKVADVKKQLVSGEAVLVWSELHESVNIMPAAQFRPD

SEQ ID NO: 6660 - protein, 85 aa, Proteus mirabilis
TLHPTLCSDLGCCPRLLTLLFISPMGRNAHFSHLIHIFGTNLYFNRDTMRTNERSVKGLITISFGDSNIVFNAARARFIKAMHLA

SEQ ID NO: 6661 - protein, 66 aa, Proteus mirabilis
LTNPRSWEIKIKVVFLDIVIRCNSCNISLRKGASNAVVGSSAINNLGDNAKAMAIITRCNCPPLNW

SEQ ID NO: 6662 - protein, 200 aa, Proteus mirabilis
KHCPLSYGRYLYNHLKTKENTMLTPTKNSALEYLKSHPSTKEFHIETIGQFFTYLKDSILSLFNSDHKFSYLGKMSVADFNLMYIRKDLHTFLTNPFLNKSEHKDKVGALQYSFDYLQNQAHITPNLYNVYRSGNFEPNELISQLINYGNKLIKNNLSTEEAQHGKYVIETLKEVLNNLEKLSNTEKMRLRILSIVNERK

SEQ ID NO: 6663 - protein, 99 aa, Proteus mirabilis
TVMLYTYSVSIYQSDLDAFLSLLTKHDEVLLIQDGVLAVLEDNPLLIYCLAQQISVYALIDDVLARGLKDQVSHQIKLINYGDFVDLTVKHPQQIHWGA

SEQ ID NO: 6664 - protein, 207 aa, Proteus mirabilis
KIMLLSVLYIIGITAEAMTGALAAGRRKMDVFGVIIIASATAIGGGSVRDILLGHYPLGWVKHPEYIVTVACAAVITIWVAPMMKHLRRLFLILDSIGLMVFSIIGAQIALDMEYGPIIAAIAAVITGAFGGVLRDMLCNTIPLVFQKEIYAGVAFGAAWLYMGLLFYTPLPKDVVIIITLVAGLTARLLAIRYKLGLPVFNYENQD

SEQ ID NO: 6665 - protein, 579 aa, Proteus mirabilis
VELPLAKKKAKLIGRVMLKRIKISQGLMCVLTLFCIIQVISGVQSIHDAYQTQNKLKQISYSFDQLRTMDNTYAALNTLRTDIIAQAFSYIADPQVEDANITTFIQTMDARKAEVDTLMNEYVELSAQTGFDQQRMAEIKQLYQKSRYDLDLLVQYLNERNTNAIRLILKSPANDNFTNSLYEATDFITDDVVNPSVIEAEDNYHEMLWIASLFMGIFLIFTTLVLFWIRKHIIVRINQMIEYQEAIASGDLISRIDHDITGRNEIDQLMLGLQQMRARLKEMVSAIRNSSTTIYSGVQEIAAGNNDLSSRTEEQASALEETASSMEQLTATVRNNTESAREVTQLVMSTADIAVQGGEHSNKMVMTMTDIADRSQKIGEITAVIDDIAFQTNILALNAAVEAARAGEQGRGFSVVASEVRNLAQRSAEAAKEIKELIESTILRVKQGNDLVEQVSLSMGEIVTSVNHVSGSMKEILAASEEQTRGIAQISLAVNEMDKATQQNAAMVEQSTAASATLSEQASMLDMIVNTFKVEQVAVTSPRSPTFSAKPAETEITKTATTSTIKSHHHEADDNWESF

SEQ ID NO: 6666 - protein, 356 aa, Proteus mirabilis
KQYPTCDFYLEQKKHCLSAVNSYSIKMWRKGFMKKSLLAALALTMTLGMGNAVAQQLTYPTKNIDVVIPKNPGGGTDTSARTIIEFAKDVMPAGRIFVPVNKPAGNGLTGLIEVANARPDGTKLVMTTVELAMFPHQGKSPVTYKDFTPIATTIADPVVLVVNANSPYKTLEEFIAGAKANPGKLKIGNSGMGAIYHLAGVNIERTTGTKFNHIPYNEGTGPSIAALVGDHIDGVLTTPGAVKSQVDAGILRILGVMDERRFPLIPDVPTFKEALNLDTNVKMRAWAVLATTAGVPDNVKNELVGAFSEVVQKPEYQEALKKQGIMPVFIVGDDAYQMMKEDHEMYAELISATLKK

SEQ ID NO: 6667 - protein, 320 aa, Proteus mirabilis
MKTFHLSLGIGLIAILSMISLFIGAGDITPASLFTDPDMRDIFFISRVPRTLSLLLAGGAISVAGLIMQLLTQNRFVEPSLAGTTQSASLGLLVVMLLFPAAGIFTKMMVATVFALLGTVLFMLLLQRIALKTALIVPLVGIMLSAVIGALTIFLAVYFDLLQSLDAWTSGDFSSVLQGRYELLWLVGALALMACWVADSFTVAGMGREFSINVGLNYRKVMIIGLSIIALISGVVVSVVGALPFLGLIVPNLVSLVMGDNIRKTIPWVCLSGGAIVLLCDVIGRLIRYPFEIPASVILGAVGAVIFLFLLLKQQRYAKS

SEQ ID NO: 6668 - protein, 65 aa, Proteus mirabilis
LDKFLTSANLFICISTPHKNEVFYIICKIFTYFFIRLFLLFSEIHEWLLLNNSFVLSFLRKLMTL

SEQ ID NO: 6669 - protein, 625 aa, Proteus mirabilis
RGNTRMEGNWMIKAVLFFLCAAVIMVPIAQRLKIGAVLGYLIAGIAIGPWGLGLFKDVDYILHFSELGVVFLMFLIGLELNPAKLWELRRAIFGVGAMQVVFTASVITGLLLLLTSFSWQAALIGGLGIAMSSTAMALQLMNEKGMNHNEGGQLGFAVLLFQDMAVIPILAVIPLLAGETASSDWYRIALKIVSFAALLICGRYLLRPLFRLIVKSGVREVFTAGALLVVLGSALFMEMIGFSMAMGTFIAGVLLADSEYRHELEISIEPFKGLLLGLFFISVGMSLDIGILWRYLPQVLLGVVILVLIKGLVLYGIAWLARLRFSTRLQFSAVLSQGGEFAFVVFSTSMAMGVLNSEQMALLLVVVTLSMMTTPLVMQMTDAVLSRRYNDAKIDEEPFVENNHPEVILVGFGRMGQVVGRLLMANKVNVTVLEHDVGSLSTMRKYGYKVYYGDATDLNLLRAAGAEHAKAIVITSNEPEATMEIVHLCQRHFPQLQIIARARGRVEAHELLKAGVTEFSRETFSSALELGRKTLIELGMHPHQAYRAQQHFRRLDMQLLRKLVDESPEEVSNVSRVKEARRELEELFNEEMRQEHHQPDIWDESLTDAIPQVNREKRPIDKQEN

SEQ ID NO: 6670 - protein, 300 aa, Proteus mirabilis
RLRLLLLHLTFGAIFYAMCSTPIIVNQSGINMNNLLTLNQVSIYDPHSEKKRVDNLSFSLKQGRTLAIVGESGSGKSLISKAIIGLLPSTLALSGEIFFDEKPLHLYSEQQRRALLGTSLGMIVQNGMSAFDPLIKIGKQVSQTLIYHFSYTKLQAFNATKQALDEVFEHQSLMIMQAFPHQLSGGQLQRVMIAMALALSPRLLIADEPTTALDAPLRREILQLLQRITISKNTTLIFISHDLGLVSQIADDILVMKEGKLIEFGDKNSVLDTPKQAYTRYLIEARAKLSQRFAQVLYAR

SEQ ID NO: 6671 - protein, 261 aa, Proteus mirabilis
KSRFNVRNVPLESVDLLERDVIALGTDYLPNTLLETHRHRRAQFLYPATGLIEVSTNDGEWVIPPSCGVWIPPQTGHETRMLDVSTRSLYIEPAAAPRQSQQCEVLRVSPLLRQLLLEAVDVPAQYDKKGRDGILMQLILYELAKAEPLPFFVPIPQDSKLAKLCRDFIRQPKIDALPQQWAEKLHKSERSFSRFFRQQTGMAFSQWRQQVCLLNSLTQILSGHSITAVAFDLGYNSASSFSTMFKKQMGQSPSDFVRNAP

SEQ ID NO: 6672 - protein, 121 aa, Proteus mirabilis
RCLTLTAFYRCSMRSIIINKLILATFMLSLTGCSSVMTHAGPNNELYSGTKNNVNMLSDDETGWAMKPLVILDLPFSALLDTLLLPYDYYTQHDDNSDNSPKERIKKLGSTNDTLNTGNKT

SEQ ID NO: 6673 - protein, 326 aa, Proteus mirabilis
FKRLLQYGTDPVPYWLKQMLRYLCWRLLAILPLVLIISFIAFVLLNLAPSDPAEVALRVNEIVPTPEAIEGMRRELGLDKPFFTRYFLWLLAGFQLDFGTSFLTRKPVIQEMLTALPPTLWLAATALLFTLIIALPLALWCVAKPHSLIDKSIRLIVFVLTAIPNYWLGLLLIWAVAVHLDWLPVSGMLTPQSVILPAFALSLGYIGTYLRLLRGAMLNQWHQPYVFYARTRGLPDKLILRRHILRNSLASALTALGMSIPKLIAGTVVIENIFAWPGVGRLCISAIFGRDYPMIQAYILMMSLLFLFFNFLIDIIQMKVDPRLRR

SEQ ID NO: 6674 - protein, 116 aa, Proteus mirabilis
PSQTEKQLGTGKLFVIMLISALFSNWAQSLFAGSNFGGLSGVVYALISYVGLTGLRAPEKGIGVPTGLNCFFHIWIIAGYMGVLGDSIGNAAHFAGFLIGLLMALWDNRHQLSRQS

SEQ ID NO: 6675 - protein, 244 aa, Proteus mirabilis
LLETIIRYFMYGITKARQLALFSLTNINKFNHDKSNAEIIFKNLTFDINNEHFTLIKYQQENEKNALIDIISGVDIQYAGYTYFLGNYINILDEKQRALLRNRMIGFVFKENYFFNHCNVFDNIYYSVVDHKDKKKLKNNIINTLKSMGIEKLYNKTPKSLSTDQLLKVAFSRALVKKPKCIIANYNNDCFSQNNFDYFIQLLSQVHKDLSIPILLITNCNHLNMTVDKIITIKHGELYDGEKT

SEQ ID NO: 6676 - protein, 748 aa, Proteus mirabilis
FRYASEGGNRGERREMATIKDIAKLAGVSHGTVSNVLNKRGNVSVEKIEAVYQAAKQMGYQLNTQAQLLRTNRSHKIAILLPQLVSEKYAIFFNAFRQSIVNFPEISYDLFLTDLLETTERDLLQKIAAGGYKQVVTVSCLKDAKYYFDTLKLPPSQIIFIYHKPLNAQRFFTLDFAQAAESICQQVAQTAGKVVGIFGDNQDELNSQVFANQLQIRLSQTAPDKKCVILSASDEESYKIAFDFFSMEQVPDIFVTQDIEKARYLTQASYFGSSSDCPIIFALSDNIPPVIKGLYCFPMNYAQLGLEVAEALLIAEPHEYKNNNVSVANRSSYLYTATPAVMSDDKSQISLNLLTLPSPSTTALKKLLPHFYRQTGIKVNLAIHPYDEVYQILSQLHLHPYYDLLRIDMACFPWFAERILRPLDKIGDGLTDLLSHFSLPTQQKFGLVNDVAYAMPFDASAQLLFYRKDLFEDTILKRMYYEKTGNELTVPTTFEEYDNVTQFFTELHQAGQAHCPMGASTTLGSAGLIATEYLLRYYAKGGRLIGSDNIPRLAMPLAAEVLADYLHQLSITENINHKWWSGSVRQFEQGHLAMLISYMNLFNDVAHSDILPKIGFAPVPGGVPQLGGGVLGVSRYSRKSSYAELFYRWLYSPVVMDHLILLGGNSNHENFSHNQEISHRYPWMTLAYQEINQGIRESSVPNGKLFNLRQAEIIIGQGITNVINHIMTIEETIDYINQRLLIDTQGER

SEQ ID NO: 6677 - protein, 128 aa, Proteus mirabilis
SCGAVLMKKMNSVAFIFTQAPHGNSAGREGLDALLATSALTENIGVFFLSDGVFQLLENQQPEGVLSRHHAATFKVLPLYDVTNVYISQEDLAHRGLSSQTMFILDAKVITAQEIAQKLSHYDVVLRF

SEQ ID NO: 6678 - protein, 320 aa, Proteus mirabilis
YYYLGVWSMPLREKKYHQNQESILFFPGQGRPYLGMGNRVYRDVPSIKEVWNCASEIAGFDVRTVCLKGPMNKLVQTCYQQVALTTINIASLYLLREHCCVNEAGYSGHSAGEYSALFAANVLELESVFKLISYRASIMQQLAKNNKGVMYVVKNCSYQTLSTLIDQQDLATKVNICCDNSELHQVIGGEYASVRKVVNQLANMKIETNKLAVNGAWHTELMSEGKNLLAHFLQTIPFSIPDKPLVMNVSAEIVSDIETIKQNLVNQLTETVRWTATMALWCHLGYHNFIELGDSKSLYYLAKNSHTLKDKNILHVNDYI

SEQ ID NO: 6679 - protein, 66 aa, Proteus mirabilis
KKYFLFFLKDLKQSLILSIIAIFFVLYSVLIVRFFPYFYGRILLVSFVIICLIFSFLPIKKEEKRK

SEQ ID NO: 6680 - protein, 105 aa, Proteus mirabilis
YWLAQRIATLTHPAYQRLSLKRSFRSLKATGKTHLEASFPLRCFQRLSLPHLATGQCHWHDNPNTSGAFTPVLLYYEQPPLIFQTPRQKGTELPYDVFNPNWVPI

SEQ ID NO: 6681 - protein, 926 aa, Proteus mirabilis
ERKARQMVKAVNEASPRNLPADAVVCPCENEHRPVYPVRYAYTNFYCDLHFSTIEQAPNKTLEASIPPSINQLLNAKDVTASKGFSARLLRQGWVYVFEEGNYPTRSNSSNKSYQEQNVDATKGRLLVFQHQVTTSDGNENFIPYIFKQLKNGGVTLKKNGNSNPYLAIPKDVKEATILFSESKLSDYTLKKIISSSKFRSKLMQKINFIDYNNNDYCIELNKDNLNRLVEDYKEEVDKFKLFVKEFTHSNIPSSFFSDTTKIPDLPQDATVLINQINSVLDYNEKATLLILKDPVGYQKDVLSYYNIVTKLHLLYQNYYSHPDKIGQFITSIQEASHHIKDTDEKEKMQTILKESINQNALDNEWKNIHKTFIFFEKHQRIVLSLYESFMNNPAIINENGGLKHYFDYAFSYHERITKEDVFSIDFFKDLNQAFDLYFDLISPLMNSTEGQRTLDKLYSINDEENNSLWVGVTKKVISLVANSKIMDALLNAQEYAENIENFVNKLAFICSDSIGFAFTKTSKMLSHYDIKNRLINTKGIDYLAQKILAMILAFCNTKISLTEFVKLSGNELNQWVEQLRKLTEQIVPNLQHPKLNKLFSWKQKIINLGEETAILIPKIEITDITKNKIYIYGKDALQVSTKLFLNGFSMITGSIQAYTLQGMSLYERNDPLKLSPYNLYTAQIIANLFVASYSILKVSQEATKLSQTVSSTTLKFFLDKIKLPMLTTEVGTKRMAALGKIAGGVGVLLALRDMSEAFHIGNRAQGMSNLVIALGSIILIWATGGWALFAGALILGGVISSQLTSWSHLETLLKHSFWGNEESSNFWDNDRPTPIEEQLKQYIKEFEFYEQKGLIELQEFYNLFYTAKMTQEKIPNGKLRLSFEFTNFIPGISEVYFHFVTQVGYHTGLAEEIKTPSSAYVLNKR

SEQ ID NO: 6682 - protein, 191 aa, Proteus mirabilis
MNLAGRVIINEYLSNTKNMAEKRNIFLVGPMGAGKSTIGRQLAQQLSMEFYDSDQEIERRTGADVGWVFDVEGEEGFRQREEKIINELTEKQGIVLATGGGSVKSRETRNRLSARGVVVYLETNIEKQLARTQRDKKRPLLQGVEPVRDVLETLAEERNPLYEEIADITIHTDDQSAKIVANQIIELLEKN

SEQ ID NO: 6683 - protein, 258 aa, Proteus mirabilis
MTMANDNAGNKIQVRDLNFYYGKFHALKNISLDIAKNKVTAFIGPSGCGKSTLLRTFNKMYELYGEQRAEGEILLDGNNILTDKQDIALLRAKVGMVFQKPTPFPMSIYDNIAFGVRLFEKLSRAEMDERVQWALTKAALWNETKDKLHQSGYSLSGGQQQRLCIARGIAIRPEVLLLDEPCSALDPISTGRIEELISELKSEYTVVIVTHNMQQAARCSDYTAFMYLGELIEFSDTDTLFTRPAKKQTEDYITGRYG

SEQ ID NO: 6684 - protein, 162 aa, Proteus mirabilis
AVMAMNGTITKWFEDKGFGFIKDENGDNRYFHVIKVANPDLIKKDAIVTFEPTTNMKGLSAYAVKVIPDSKYIFIAGERVKLTSIKSYRVYSEQVPVKTHIDKENTILSVGMLMNSIKPKSESAADQTRTLKKIDIITYHGKVLTFTDDEVDIDATVKVIKA

SEQ ID NO: 6685 - protein, 124 aa, Proteus mirabilis
PQFYKDIKMSKSLLGLLFASLLLVGCQAPKPLYNWDSYQTVVYQYYQQSESDPHAQIDALKKSIEVARAKSLGVPPGLHAHLGMLYVTTGALDLAMSEFDQEKTLYPESAKFMDFLMKNKGAQK

SEQ ID NO: 6686 - protein, 809 aa, Proteus mirabilis
GSIYMSNQSDHHSIKPISGDISRRHFIQASSALVTLPFFSSNTMAATQDHAIAEKTIDAKESERVVSTCSSFDCGGKCDIRAHVKDGKVTRISTRPDADLDEEMPIMRACVRGRGYRKFVYHPDRLKYPMKRVGKRGEGRFERITWEEATTLIAQNMQRITKQYGPASRFVSLSTGVTGGIFSGANMLRRLFNLTGGFLENYHSVSNGNTLAVTPYTYGTAASGSTLDTLANTPLVILWGHNPNETIFGHSNHYFQKMKKNGTKFIVVDPRYSDTASSLADQWIPLLPTTDNAMMDAMMYVIVSENLHDQAFIDKYTLGFDEHQMPEGVGENESLVAYLMGKKDGIKKTPEWAEPITKVPADTIRQLAREYASTKPAALIQGWGPQRHICGERTARGATLLATITGNVGVRGGWAAGYGMALNSELRKTIAGPSLLTNPVKAKINITNWVQACEDKNLVTPQNGLLNAEKLDTEIKMIFSMAGNYMVNQNTDILHAAKVLEDESKVEFIVCSDLYLTPSAKYADILLPETSFLERWNIGGTWSYGDYIILSEKVIEPEFERRTDYDWLREVADKLGVGEQFSEGKATDRDWIEYLVNDASIKRPEDGIPTFDELLVKRRHLLKHRPHTQNVAFEKNIQDIENNPFPTPSGKIEIFSKRLYEMNNSEIPALSHYVPAIEGPEDTLTDKFPLQLITWKGRNRANSTQFANPWLQEVQRQELWINPLDAEDRNIKQGDKVKVYNDRGITLVPVKLTQRIMPGVVALQAGAWWQPDKQGIDQGGCANVLTSSRSTAMAHGNAHQTLLVEVVKA

SEQ ID NO: 6687 - protein, 255 aa, Proteus mirabilis
IKIYLILLFVIGFAQQKSMTIGLFHRYWMMKMTFNKLSLGVVLLSASLLSGCASESSRSLEVAKVATYNTTYSGPKSAIAIGKFDNRSNYMNGIFSDGVDRLGNQSKTILITHLQQTGRFNVLDRANLTELTQEAKIKGQSQQLKGATYVITGDVTEFGRKEVGDRQLFGILGRGKTQVAYAKVNLNVVNVNTSEVVFSTQGAGEYELSNREIVGFGGTASYDSTLNGKVLDLAIREAVNNLVAGIESHAWQPEQ

SEQ ID NO: 6688 - protein, 739 aa, Proteus mirabilis
GLVYRFSLLLPVKDYWMSITNSKKYQRLGDKDGNPLNGGKTLTHGGGRTYAQDLALQEQHRQLIEKILSGDMQSGLVFTCQIGGLPEETFQVTQFDLQEGISQLFTLSIQAVSPLSEIDFNDVLGMASSLTVKRDGHILRTVQGILAAAEQGNTDGVKTWYQFVIRPEMWVMTLKQDSRIFQDTTVPHILETLLNESHIKYDKQLYHPEEHLQRAYTTQKRETMYDFWCRLAAEEGINFWFEEGPQLFYSDRHLGMRAGISLTYNPQSDTDITDSTATTWRYVEQLCSDIRVDKDYNQLRPSYPLSHQVTGEVHQQHEIFESYGRFEEDAQGQPFNQIRYEQSQNQRQVGSATTNCIELAPGRIFTLSNHPSARMNTTWQVISISHHGVQPLADNSGGEGTQLSNQLSFVPSTQEWRPPYRFKPTADGDELATVVGPPGEEIYTNEQGAVTVYFHWDRRGKPDHSASCWVRVAQGWNGDGFGFMAIPRVGQEVIISYLNNDIDKPIITGCTYNGRNRSPIDLPKHKTRTTFRTKTHKGDGFNELRFEDKNGDEEIYLHAQRDNNIHINHNKTQYVGHDDSHTVANNRKHEVCHDEFIHIVNEQTVQVDVNQFEQIGKDRITRIDNSWKEVIHASHFQEIGENKQCDIQNDYTLKAAGGIHTHTKIHTLQASETVIIKGKAGSIQLDAQGVTITGKILLKGDVSITGGAPEVVTQLEAAVNEGLPLAEDCRAKAMKKGTA

SEQ ID NO: 6689 - protein, 312 aa, Proteus mirabilis
HYVYLRMKEHVKMAKTSSSSLQVQTEKELHIRHKRQLWRRQKNRIALFLSVSTMAFGLFWLMWILFSTVTKGFDGMSWALFTEMTPPPNTDGGGLANAIVGSGLLILWATVIGTPLGILAGIYLAEYGRRSWLAEVIRFINDILLSAPSIVVGLFVYTIVVAQMQHFSGWAGIVALALLQIPIVIRTTENMLKLVPDSLREAAYALGTPKWKMIAKITLKASVSGIITGVLLAIARIAGETAPLLFTSLSNQFWSTDLNEPIANLPVTIFKFAMSPFSQWQELAWAGVLLITLCVLFINIIARVLFAKNKHG

SEQ ID NO: 6690 - protein, 727 aa, Proteus mirabilis
ELPYVRWHFKFVIVTKQHQHEYGEKMRLSVIILAIFMISLFIMAAFLFFKRRRLDGSYHLPSLAKPTYRKLTQDDYGVISDYLSYFGTSKFSSGYSLQNFPEIPTKGEVVTTLRNIVNRFAGSSEGLNHWRYYIDAVEIHIPPLLVPYLQQENVLDVVCTPSIPIVIGVNGHFLKDEKSHFSALSLKQLSEPILSNGTSTIQKNEGDAAHLLHIRQETNEEYRLHHSSGFWNGSLICLGLILWLTALMMPQVFLPWIMAAGGTFLVLGLFLIYRPIIKSRKQEVQCFKGRLKRWGLFGNFDHGQVKNISLGGIDLVYPPHWEPYIQNDIDKVTYLEMYPNHHVIKQGPYLSLHDEEKNYPYKRYIKNIIFVVCSLFVIGMLYLYQPLSLSMKLTFSWIKESEPHLVTNFTELETAKLHVGDIIQAKGVGMCYMPPNLSSKNNKTIFAPFDCSGIYWNNSNPMPMPESSTIEKAAALLYLVEEQLHPVSNNRVNPSLGQAITKSGMNLLDNFDGIILKTQDLCPRENECIRLKMALVNLSNVNDWPSLVQRAESGKLTGTNVLLRAVSAEALEKLVDTTTSSFIYREIDKAAILLNSPPPGGVLLISDERKQLVDYASNTNSVFEPTPLEQWRELQRLSDILLHTPFNTGGVITGMVIDANGTLQIFLHSMPDSMTLLYYIGNTLLLFFAIGFLILNLFFIIRRRRQNNQRMHKISQYYEHCFYRPPQ

SEQ ID NO: 6691 - protein, 376 aa, Proteus mirabilis
SLDYYLIHFIYGTGPLFAIARYIGVFNTEIQKGLFLALTFLLSIFSYLLIEKPFRRKRLNFKYSITLLFVIPILLALGLNALNEKYHGFGVRLGQNYVNLENKLNQFDYPNRGNCMNFQASDPDKMCHIGKVGSQKKAFLLGDSHANHFWGFMDILGKDAELDVYAQATSSCITIPNIYLYDWSNHKNTVYQRCYDQTAKYYQIIKHNRFDYVIFGQVWNNYASNHVINKIGDKRTVEASRQRVEKSMREALDIIVATGAKPVFIKTVYSMPSGFMTCFYENAKLRKDFADNNCNPKNYKGEGNTWMNQLFAKLKQDYPSLIIIDPKDVQCDKDTCLTDIEGVPVYRDVGHITDYASTIFGMMYINKMGNPFKENQ

SEQ ID NO: 6692 - protein, 69 aa, Proteus mirabilis
SSCYFIQIILYGRSSSPVGRLDFKSRWGRQRSLAGSTPVIFRQLSSLHLPKLNQSLNYQLLSYFQFNKC

SEQ ID NO: 6693 - protein, 253 aa, Proteus mirabilis
AGGYMATQIDFTLSNKVAVITGGAAGIGLSIAQMFIEKGAKVALLDRSEQVEQVAHRLNSAVGIWCDVSSEESVKQAVHSVIEEFDRIDILVNCAGIVALAPAESLSLEDWNKTLSVNLTGTFLLCQQVGQHMLQRGQGKIINLASQAGIIALPEHIAYCASKAAIINMTKVMALEWGPKGLQINAISPTIVMTDLGKKAWEGEKGEQMKAQIPARRFAEPEEIAAAAVFLASGAADMINGHNLVIDGGYTIQ

SEQ ID NO: 6694 - protein, 497 aa, Proteus mirabilis
LNILFIMTLSFARLRKPVYWWIIGYAVLWIIVSYLFDPTVPYDAVEAVNWGTNGGWGSPKNPWFVGFIMWPAIYGGIDFSFYWYFIHFVMIAIGLLGVWNLAYKLTKNYHLAWFAMLGLNLSGIINFDIIPYNDNYILVGCWPWALYFFLCAINDNPKYWCGFAAVMGVATMGKYSSLALIGAVFLLSVLVPKVRQSYRSPYFYFAIAIWLAFVIPNFIWLWQNDFAAFKWVDSQIEARFNLRTLRAALTVFYPVLLMWGIVRLYGGRVSWRTSQDSQLLNFILLFPLAIIFIWFSFHEGGRITEWLQPFMSVATALFVGSISVIPKRSLRGVLYGLAVFGMLVVSGYTVVQAANVRNAGQKFIGVKTFVQDVENAWHQHYHQPLSYVGGEYMHEWITFYGKDRPLSAQPWIVEKDVQPPNIYNRHITLAQLEDKGVLLIGPVGYYCDKAHFDAGLQYWPSLKIADTQEVMFRSEPDALAEPVCIAFVSPKQQSEKL

SEQ ID NO: 6695 - protein, 88 aa, Proteus mirabilis
HKIYILHYSKRLTILTFPNTKQLHLATENNKLKYNKLLLLYLKKLAQHNHKQGTKRVSSLIFIYSNITDYFPDITLFALFMNILWITL

SEQ ID NO: 6696 - protein, 320 aa, Proteus mirabilis
WMCYMALLTHVSVIRNKECIMAENNVTPVISAPVPMTPFQEFWHYFKQNKGAVVGLIYIVIMLLIAALAGVLAPHAPNEQFREFLLTPPVWQEGGSWSFILGTDDVGRDILSRLMYGARLSLLVGCIVVILSLILGIILGLMAGYFGGIVDIAIMRVVDIMLALPSLLLALVLVAIFGPSIINASIALTFVALPHYVRLTRAAVLTEINRDYVVASRVAGAGSIRQMFINILPNCLAPLIVQASLGFSNAILDMAALGFLGMGAQPPTPEWGTMLSDVLQFTQSAWWVVTFPGLAILLTVLAFNLMGDGLRDALDPKLKQ

SEQ ID NO: 6697 - protein, 225 aa, Proteus mirabilis
VMRYFPSVFIGNITTTANGFTSAITKRLVDGHIKLTSLGLAGDEQAEKGFHGGPDRALCHYPQEHYHYWSEQFPQLADLFNAPAFGENISTTGLTEENVFIGDIYQWGDALIQVTQPRSPCYKLNTVTDISDFSQLMQDSGFCGWLYRVISPGEVGCHHPLVLRSRNSDISVKEAIAIAFHMPFDEESYRRLLTAAGLSASWCKTMQLRLQKQTIESFDRRLFKK

SEQ ID NO: 6698 - protein, 255 aa, Proteus mirabilis
SKKYSIITVVQAWLLEIALMKPHLKRSLTIKQMAAVAGVTLVTIAIFISIQLVYLIDQRREDYQNQLFNAAVSIQQPLADALLRSDLNDAKQLIISLKTTGILGKAIVTQPENVQVMNLDFAPKKSVSQFSRWLFGIPVEVTIPLQPLGITSADDKAYTSHLILQADTNRFYRFASNTVALMLTTYLLMGLILTIAISWCINRIMVKPLRHIAVTLNKSNQVSMLSCSESHRDDEIGLLIKGYNQQKSDQKESDI

SEQ ID NO: 6699 - protein, 73 aa, Proteus mirabilis
KKPLSLSITEANYFTDTLWDIFKIRDNIIKLNLDKYLIDIHAQQSLVLTMIASTPLIPLNVGNSNHSHVKDYQ

SEQ ID NO: 6700 - protein, 165 aa, Proteus mirabilis
CKGYRRNSLSDRLISLWKEFTMAYKHILVAVDLSPESNVLVQKAVSMAKPYNAKVSLIHVDVNYSDLYTGLIDVNLGDMQQRITDETRNALKDLSDNSGYEIQETLSGSGDLGQVLVDAIKKYDMDLVVCGHHQDFWSKLMSSARQLINTVHVDMLIVPLKDDEE

SEQ ID NO: 6701 - protein, 727 aa, Proteus mirabilis
GKGYQMNKINSVCPYCGAGCKINLCVENGRIIKAEGANGVTNQGELCLKGLYGWDFLNDNKLLTARIHQPMIRRQKGADFEIVSWDEAIEFTAKKLLAIKEKYGAKSIMCTGSSRGTGNETNFVMQKFARAVLGNNNVDCCARVCHGPSVAGLQETLGNGAMSNSIADIEDSDCLLVFGYNCADSHPIVARRVVKAKQKGAKIIVCDPRKIETAKIANQYLPLKNGTNMALVNAFAYTLIDEDLYDKEYVSRYTEGFEEYKKQLVDYSPEAVERIVGVSASEIRQAMRTYAAAKTATIMWGMGVTQFGQAVDVVKGLASLALLTGNLGKPHAGVAPVRGQNNVQGACDMGVLPNMFPGYQSVTDEGIRQKFAQAWHIPVEKLDPQVGYRITEVPHLAIEGKVKAYYIMGEDPLQTEADLGLVRKGFQALDFIVVQDIFMTKTAEQADVILPSTSWGEHGGIFTCADRGFQRFEQAVQARGNVKRDWEIISLLATAMGYPMSYTDNEEIWHEVRALCPLFFGATYEKLAGLAHIQWPCPELDHPGTPYLYSDNRFTTPSGKGQLFATAWRAPAELPDDEYPMILSTVREVGHYSCRSMTGNCKALASLADEPGYVQIHPDIAKAAGIADQEIVWVASRRGKVLSRCNLNETVNKQAIYMTYQWWIGACNELTQDNLDPVSKTPETKYCAARVVKIDDQKWAESQVAQDNHAMRSRLINLVEQAKTATH

SEQ ID NO: 6702 - protein, 404 aa, Proteus mirabilis
MYHLDVYGTLVAATLVLLLGRNLVKSVPFLERYTIPEPVAGGLLVAALLLALKSFMDWEISFDLSLKDPLMLAFFATIGLNANLASLKAGGKALFIFVFVVVGLLLVQNTVGIALAEMLGLDPLMGLLAGSITLSGGHGTGAAWGKTFVESYGFMSASEVAMACATFGLVLGGLIGGPVARYLIRNIPTPGAGSDDHEMPTAFEKPATGRMITSMVLLETIAMISICLMAGTFLSQLLEGTAFSLPTFVCVLFIGVILSNSLSMLGFYRVFDRAVSVLGNVSLSLFLAMALMSLKLWELASLAIPMLVILGVQAAVMALYAIFVTFRVMGKNYDAAILAAGHCGFGLGATPTAIANMQAVTDRFGPSHLAFLVVPMVGAFFIDIVNAIVIKLYLMLPFFTPIAG

SEQ ID NO: 6703 - protein, 419 aa, Proteus mirabilis
LYFHCIAKCRSGGVMINQRINRATYDQVMLPIYSPADFIPVKGQGSRVWDQQGKSYIDFAGGIAVLALGHAHPLLNKALQEQSEKLWHVSNVFTNEPALCLAQKLIQHTFAERVFFANSGAEANEAALKLARHYAITRHNPYKTKIIAFHHAFHGRTFFTVSVGGQPKYADGFGPKPADIIHVPFNSLDAVKAVIDSHTCAVILEPIQGEGGVTPATAEFMHGLRTLCDKHQALLILDEVQTGMGRTGKLFAYMHYDIQPDIITSAKALGSGFPLSAMLTTEDIASVMGVGTHGTTYGGNPLACAVGNAAFDLINTQAVLEGVSERHRWIVDELQAINQTYAVFSQIRGQGLLIGAQLAPLYAGKAKELLALASKHGLMMLNAGADVIRFTPALIITLEELQEGMNALRKALDEFVKAE

SEQ ID NO: 6704 - protein, 247 aa, Proteus mirabilis
RHSHMDLISRLTTNTTRADFALAHQQQLIQLLIQHFPAKYHTLFATPQKTAEDTIEWYGELSGQPVALNALSEQQRQEIRDALDDDLKNLKEQTALLASQQRITDEERHLLDTASTLPDAESIYIINGKPIITWWPRTTPLAPTVAQVTAGSSAAAAGAALAKISPKTRHRWLRWLLVLLLVLIALVSWLRGCFDINTTPSINNTSATAVATHSTSTMTATTNTTNTTNTTNTTNTTNKQDNLTTNK

SEQ ID NO: 6705 - protein, 317 aa, Proteus mirabilis
FSYQNDITVISTLLLFLHTFTGLLMFLGQYWAKFAPTTLFVLLWSSGAIFSRWGLDNGSSFAILTWRFVIALLFLTLLCLQRRQFLPPKGSRLKTAWVGLLIIGGYSICYLLALANSITPGMLATIMGIQPILTLWIIERHFTASRLLGLFIALIGLVLVVAQSLFNISLSLTGMIYALIALLCMSFGAISQKKLQLAPMEALPIQYVVSLTLCLLFIPFQPMQQSWDIGFIVPVLWLAIIISVVAQLLLYRLLTAGNLVNVTSLFYLVPGVTALMDYIFLGNKMSWLSLAGMGAIIIGLIFVFKKSNSMIVEEKIK

SEQ ID NO: 6706 - protein, 258 aa, Proteus mirabilis
RLHHWALWLITRQIMDNLNHNKHISGQFNAELEHIRTELMVMGGLVEEQLKKAITAMHNQDQALANEVIEGDQKVNMMEVAIDDACMRIIAKRQPTASDLRLIMAISKTIAELERIGDVAEKICKTALEKFSHQHQPLLVSLESLGQHAIQMLHDVLDAFARMDLEEAIRVYREDAKIDNEYEGIVRQLMTYMMEDPRTIPSVLTALFCARSIERIGDRCQNICEFIFYYVKGHDFRHLGGDQVERMLTKNDDSHSAN

SEQ ID NO: 6707 - protein, 361 aa, Proteus mirabilis
LTNHYYLIKRFISHVSVSWSYSDTENKAFCYYHIIVLTRLFLTCWNWYSCGQNSILVYLLQARIMSMTEQATTRLKPGKILDTLGAMKNSLTRVSQRIADYILFHPTEVTQLSIAQLSQATKAGEATVVRFCRTLGYKGFQDFKMDLAIEMATSDNDESPILDAEVSHQDDIHTIGLKLQATINNVLSETLNLLDMQQVQGAVNALLSANYVFICGVGSSGITAEDLKNKLMRIGYRVDAVTNNHFMYMQASLLKSGDVAIGISHSGNSLETVHALKLAKEAGASTIALTHNLGSQIMEYADHHLINGNRQGKLQGDSIGTKTAQLFVLDLLYTLLVQAKPETVKEQKLRTLNALKQTHSA

SEQ ID NO: 6708 - protein, 211 aa, Proteus mirabilis
NICHIFEHFTMTNSLVVSLSVFLFIAAITPGPNNLLLTSSGAHVGLKRSLTLMAGIIVGMQCVLLSSAFGIATLLIIYPALHIGLKIIGSIYLCWLAWKTATASYQRLDISSKVSQTVTAFQGGLLQFLNPKAWMMGLGAVGSFSLAGDGYLGSIGVISVVMLLVNFIAGMVWILGGTFISRFLQSRRAWFLFNIIMGILTAMCIPLIWIE

SEQ ID NO: 6709 - protein, 216 aa, Proteus mirabilis
FSSQIQKVIMIQGTLYIVSAPSGAGKSSLIQALLKTQPLYDTQVSVSHTTRPMRPGENHGEHYFFVTEEEFKSMIASGDFIEHACVFGNYYGTSGKVIKQILASGVDVFLDIDWQGAQQVRKKMPEARSIFILPPSKEELYRRLRGRGQDSEEVIAKRMSQAVSEMEHFNEYDYLLINDDFNTALADLQSIIRSEKLRLDRQTLRHGDLISKLLAD

SEQ ID NO: 6710 - protein, 72 aa, Proteus mirabilis
YSAHVAAWASLSNQQGDPVRVDSVSIKGKSFNPPKLSGFNAVKMPLQMIPVDATATLSAWFFNGVIMLTNAS

SEQ ID NO: 6711 - protein, 183 aa, Proteus mirabilis
MGRQRTIDREKLLEAIFDIVMEQGAAALTIDTVAKKMGISKGGVQYCFNSKEAMIDAMFEHWEGGYEARFNQVVANDNSANNRVRAHIHATHDHDKLSFAKGASLMAALLQTPEYLQSTKAWYQQRLAGVDTTTVEGKRARLAFLATEGAFLLRYFGLMDIDDNEWEEIFSDIDSELVTVTTK

SEQ ID NO: 6712 - protein, 246 aa, Proteus mirabilis
KISQRQEQTMDALIQFVDTIGPLSLSSIAKLLAAFILGGLIGLERESKGKPVGFKTCVIIAVASCLLTIVSIQSAEYYANISDNIRSDPMRLAAQIISGVGFLGAGVILHRRDDAISGLTTAAIVWASAGVGIACGSGFYWHAIVVTFLFFMAIKLSPQVVLFQMNNQRLGKIKVRMLFTHESGVPLLIDYLKSNKNVIENLTIRDIKKERVEVNLKLLVRQKITLPEFYCSLKQLQHVHSVSLDH

SEQ ID NO: 6713 - protein, 349 aa, Proteus mirabilis
SGGHVMSDNLPEAPQGEFILFRSEDGQTRVECRFESDTLWLSQSSIAELYGKDVRTINEHLVNIFSEGELAQNATIRKFRIVRLEGNRQVSREIDHYSLPAIIAVGYRVRSVRGTQFRQWATQTLEQYLIKGFVMDDERLKNPPIGQSVVPDYFDEMLERIRDIRASERRVYLRVKEIFTMAADYEPSNKETTRFFQSIQNKLHFACTGMTAAELIASRADASQPDMGLTNYKFDEVRKTDVTIAKNYLRENELKELNRIVNMWLDFAEDQALRRKQVFLQDWDTKLDQFLSFNDRDVLQGAGGISKKAADEKAREVFDIYAQKRRQLKEAEGARANIAALKDLLKKGK

SEQ ID NO: 6714 - protein, 66 aa, Proteus mirabilis
HVLHKIISSPCTQLSNLNSYLSFIYPLFVLSKGNTHFLAKVFNLPAELIILLSGAPTGEEKGQANR

SEQ ID NO: 6715 - protein, 473 aa, Proteus mirabilis
TLLHERISLLGTYFSTDKWIRSIMSKHYDYIAIGGGSGGIASINRAAMYGQKCALIEAKALGGTCVNVGCVPKKVMWHAAQIAEAIHQYGPDYGFDTTVNRFDWDTLISSRTAYIDRIHQSYERVLGNNKVDVIQGFARFVDAHTIEVNGEKITADNILIATGGRPIQPNIPGAEYGINSDGFFELSALPKRVAVVGAGYIAVELAGVLNALGSETHLFVRKHAPLRSFDPLIVDTLVEVMEAEGPKLHTHAVPKAVVKNADGSLTLQLENGLEQTVDTLIWAIGREPATDNINLAATGVKLNEKGYIQVDKFQNTNVPGIYAVGDNTGAVELTPVAVAAGRRLSERLFNNKPNEHLDYTNIPTVVFSHPAIGTVGLTEPQAIEQYGAEQVKVYKSSFTAMYSAVTRHRQPCRMKLVCVGAEEKIVGIHGIGFGMDEMLQGFAVALKMGATKKDFDDTVAIHPTAAEEFVTMR

SEQ ID NO: 6716 - protein, 346 aa, Proteus mirabilis
NVIHHWMIQGDQHMANVNPNTAVPLLKAVNLAKYYSVKGGLFTKEKTVKALDGVSFELERGKTLAVVGESGCGKSTLGRLLTMIEVPTSGELSYQGQNLLVKDKSAEKLRRQKIQIVFQNPYGSLNPRKKVGQILEEPLLINTTLSAQDRKEKVLSMMAKVGLKAEHYSRYPHMFSGGQRQRIAIARGLMLEPDIVVADEPVSALDVSVRAQVLNLMMDLQQEMGLSYVFISHDLSVVEHIADEVVVMYLGRCVEKGTKTQIFENPQHPYTQALLSATPRLTPTLRRERIKLTGELPSPLNPPPGCAFAARCRRAFGMCTQLQPTLKEYHGQLIACFAVEQDHGEF

SEQ ID NO: 6717 - protein, 287 aa, Proteus mirabilis
NRVQSATLKRLRNLDGMKKKRAFLKWAGGKYPLVDDIKRHLPQGNCLIEPFMGAGSVFLNTEYDSYILADINSDLIHLYNTVKLYPEKFMKDAQLLFTPQMNNAEEFYQLRQDFNQSTDPYQRSVLFLYLNRHCYNGLCRYNSKGEYNVPFGRYKKPYFPEDELIWFSEKAQKALFVCQSYSSTMTNATKGSVVYCDPPYAPLSPTANFTSYHTNSFSFQEQQHLAQLASMLAYERQIPVLISNHETALTKEWYVDAKELHSVKVRRTISSNTLGRSKVNELLALYK

SEQ ID NO: 6718 - protein, 160 aa, Proteus mirabilis
PLGLNWNLKACRRFILPIIPWSMKNETNICRGRHCVFLMHINLVFVTKYRRKIFDQDAIEKLRGYFASVCADFDVELVEMDGERDHVHLLINYPPKLAISNLVNSLKGVSSRLLRRDRPDIAQRYYYKGVLWSPSYFAGSCGGAPISLIRQYIEQQETPS

SEQ ID NO: 6719 - protein, 160 aa, Proteus mirabilis
PLGLNWNLKACRRFILSIILWSMKNETNIRRGRHCVFLMHVHLVFVTKYRRKIFDQDAIEKLRGYFASVCADFDVELVEMDGERDHVHLLINYPPKLAISNLVNSLKGVSSRLLRRDRPDIAQRDYYKGVLWSPSYFAGSCGGAPISIIHQYIEQQETPR

SEQ ID NO: 6720 - protein, 238 aa, Proteus mirabilis
RRKHIMIYLRKANERGHANHGWLDSWHTFSFASYYDANFMGFSALRVINEDRVMPGEGFGTHPHKDMEILTYVLEGNIEHKDSMGNKENVPAGEFQIMSAGTGITHSEYNPNSDKGLHFYQIWIMPDTTGITPRYDQRRFNTTESKQLILSPDARDGSLKVFQDMTLWRWNLKKGEEAQYQPEAGRNIWLQVVKGKIAINDIIATTSDGIAIANEDIIYFVGDEDSEVLLFDLPPVTA

SEQ ID NO: 6721 - protein, 249 aa, Proteus mirabilis
KHLHFGSLKMQDSYKVLIVDDDLRLRSLLERYLTEQGFQIRTAANSDQMDRLLTRESIHLIVLDLMLPGEDGLSICRRLRSQNNPIPIIMVTAKGEEVDRIVGLEIGADDYISKPFNPRELLARIRAVLRRQANELPGAPSQDNAIVSFGKFKLNLGTREMFHEDQHMPLTSGEFAVLKVLVSHPREPLSRDKLMSLARGREYSAMERSIDVQISRLRRMIEEDPTHPRYIQTVWGLGYVFVPDGTSVS

SEQ ID NO: 6722 - protein, 340 aa, Proteus mirabilis
DMLQFILQRLGLVIPTFIGITLLTFIFVHLIPGDPVMIMAGERGLSPERHAYLMAELGLDKPLWQQYLNYLNGIMHGDLGISLKSRIPVWDEFLPRFKATLELGICAMIFAVSVGIPVGVLAAVKRGSIFDHTAISVSLAGYSMPIFWWGIMLIMLVSVKLDLTPVSGRLADSVFLDDSYPLTGFMLIDTLFWGEEGDFLDALHHIILPAIVLGTIPLAVIVRMTRSAMLEVLGEDYIRTARAKGLSRARVILIHALRNAMLPVVTVIGLQVGTMLAGAILTETIFSWPGLGRWLIDALQRRDYPVVQGGVLLIATMIIFVNLLVDVLYGIVNPRIRHKK

SEQ ID NO: 6723 - protein, 235 aa, Proteus mirabilis
DFKHAVSKGCQSVLKGCINVQRITRMVLGKPQTDPTLEWFLSHCHIHKYPSKSTLIHQGEKAETLYYIVKGSVAVLIKDEEGKEMILSYLNQGDFIGELGLFEEDQERSAWVRAKTACEVAEISYKKFRQLIQVNPDILMRLSAQMANRLQTTSEKVGNLAFLDVTGRIAQTLLNLAKQPDAMTHPDGMQIKITRQEIGQIVGCSRETVGRILKMLEDQNLISAHGKTIVVYGTR

SEQ ID NO: 6724 - protein, 92 aa, Proteus mirabilis
DCRQEQKRSVITLLFQWFHKINVGNHNRHGRDHLFHDRHHNIHLLHRDRDHDHDHHHSIRLLHRGHVRHNTHDLHLHHEHDHELILLPWLHG

SEQ ID NO: 6725 - protein, 369 aa, Proteus mirabilis
TYFKNRLRYGWLYYCHVINRKWRARMRRLLPYDAINLAAYAFFEPQEPLIPFIPSWYNVWESHMLRLAGKKSAGKSWSFQRYGVNHDMYLREGIRKTNCRPYLSAIEHVVDHAVGQLDTKSQFLLKKERNGLIYIDAWGELTAFEQIDSLRDVFTLNIIPRNIIKKYSIKNFSCKIRGERNGMMSALLLAQKLINSDLLDNIFICGGFRAVPILSFSEIERQPITLFFKPNTLENINSIERVACIIINKKQCSDISISINHYFSMNQNRKKAIKQLVKNWHRCINKQTGSIYITALLTYKYISMLETAFTALPVNLNCYFLNRLYGDSGFITPALMFDHLQKAADSASHYLLSAFDGENGVWLVDCWKQ

SEQ ID NO: 6726 - protein, 250 aa, Proteus mirabilis
LDFKYHSIQCINNNLRYRGLSMAYSFLTQATVKKLSRNEKWLQQINNEDIIDLSLNAGQLIIDKPKVDENFIPFSQQLDVYCQQIAQQFPFIAVTPQLQLHCTLLTIFNQPIALFEPQKLMLLAWCQKITNIFNKIGKIEILFNDIILTANGSVILIGVSKTLTQFRQQVYQQIPIDHHLHKNIIHITLGRLQESVSSEKITPLFQFLAHNRLSLPINIKTSINYPKFVVSKGSLSSEILLNKTIEFNQQ

SEQ ID NO: 6727 - protein, 255 aa, Proteus mirabilis
EDFNMIEISKISKRYQDTTVLDNITTTIQRGGITSIIGPNGAGKSTLLSVIGRLLMPESGMVSVNGMDVAATESDVLAKNLSILRQENQFVSRLTVEELVGFGRYPYSKGRLTLEDKKVIDESLDFLNLTEFRHRYLDELSGGQRQRTYVAMVLCQDTEYVMLDEPLNNLDMKHAVIMMKLLRKAADELGKTIIIVIHDINFASVYSDYILAMRNGQLYYHGSPKEIMKSDIIEDIFDTPVDVKELDDKLIAMYY

SEQ ID NO: 6728 - protein, 423 aa, Proteus mirabilis
KPIKRGTTMDMKITSRLLIMMFVQYFMQGAWNMTMGLVLSSYGMASIIGNAYALLGVATIISPLFIGMVADRFFASQKVMGILHLINAVVILCVPQFIEAQNSGMTLFLIFIIGLLFYPTTALSNSISFSHINGVKYFPIIRVFGTFGFMAIGFILGEMGFSGSTMTWYIASAVGVLLGFYCFTLPNTPPKAKGQPFSLRDILCLDALSLFKDRYFAILMFSIFILMIPKTAYSAYIPVFIKALGFDNAASIMQIGIACEVLFMFVLSFFLMKFGFKITLLLGAVSWIIRSMFFSYAAVNTELYFIVIGLMLQGLCWDFFFTAGDIYVDRKAKPEIRAQAQGLRFIVSNGFGLLFASTICGQIFNTTVTETGDAALPQWSTFWVYPAIVAAVVTLFFIFFFKDDVSKKRNSENKETSRGITAP

SEQ ID NO: 6729 - protein, 240 aa, Proteus mirabilis
IIVNTSRQWECCQENAMKDFLIAPSILSADFARLGEDTEKVLAAGADVVHFDVMDNHYVPNLTFGAPICKALRNYGITAPIDVHLMVKPVDRIIPDFAQAGATYISFHAEASEHVDRTIQLIKDCGCKAGLVLNPATPLNYLDYVMDKLDLILLMSVNPGFGGQSFIPKTLDKLRQVRKMIDDGGYDIRLEIDGGVKVDNIAEIAQAGADMFVAGSAIFNQPDYKQVIDNMRRELDKVSK

SEQ ID NO: 6730 - protein, 193 aa, Proteus mirabilis
SLFLSGAVMKELKKPNILNIDNIARSRLFQIQSVNLEFSNGEKRIYERMKPANREAVMIVPIINDDLILIREYAVGIENYDFGFPKGAIDAGETPLQAANRELKEEIGYGAGSLTEIAKLSMAPSYFSSKMNIVIAQDLYPEQLEGDEPEPLVQIRWPIAKMMDLLDHPDFTEARNVSALFLAQRYLQQVCPK

SEQ ID NO: 6731 - protein, 239 aa, Proteus mirabilis
GLYNQMSSPLFYGDSNEFEKLDSRPFTQTDHEILKSYEAAVDGLAMLIGHHCEIVLHSLEDLKCSAVKIANGEHTGRKIGSPITDLALQMLHDITDEDSSFSKAYFTRAKSGALMKSITIAIRNRERRVIGLLCINMNLDVPFSEIIKTFIPEETHEVASDVNFASSVDDLVAQTLEFTIEEVNNDREVANNAKNKQVVLNLYEKGIFDIKDAINQVADRLNISKHTVYLYIRQFKNGE

SEQ ID NO: 6732 - protein, 139 aa, Proteus mirabilis
GKNKMEARVKWVEDLSFVGESSSGHQVMMDGNSGDKAPSPMEMVLIAAGGCSAIDVVSILRKGRHQVTDCEVKLTSKRREEAPRLFTDINLHFIVSGKALTDKIVERAVQLSAEKYCSVSLMLGKAANITHSFEIKDPE

SEQ ID NO: 6733 - protein, 529 aa, Proteus mirabilis
KENNVKPLFTVIPTLLLTLACVFPAFANQSNNILDYASTKDIRDINPHLYSGEMAAQNMVFEPLVLNTDKGVAPYLAQRWEISPDGKSYTFFLRQDVTFSDGEPFNAQAVKLNIEAVLDNYQRHAWLELVRQIDSVEVIDQYTVKLNLKNPYYPTLTELGLTRPFRFISPKSFINGKTKTGVSHYIGTGPWVLTEHKKDQYAEFKVNPHYWGQKPALTGVMWRVIPDRQTMLLSLQKGDIQLIFGADGDMLDMDSFDALMASDKFKTQMSAPIASRAIVLNSSRPITSSQKVRQALEYAVDKEGIAQGILAGSEKVADTLMARSVPYCDFDSPTYIYQPEKAASLLEEEGWLLPAGKTVREKQGKPLQLLLSYNVNNAVEKEIAELLQDDFKKIGVALTVLGEEKQAFLDRQKSGDFDLQYSLSWGTPYDPASFVSSFRIPAHADYQGQKGLANKAQLDAMIGELLITPDEHRRQALYQRLFTSLAEQAVYIPLTYSRTKAIYRSELENVGFNPSQYEIPFEKMRFKAE

SEQ ID NO: 6734 - protein, 322 aa, Proteus mirabilis
RRNKMNEWSLLIFTFMMNATIGLTLITGLFARRLAHYLSAESYYRFMLLTLLVICGLAGLGSIASITHLGVPLNAPNAIRNVFSAWLSREVAVTAIFVGCLGITFLWLWRTGKFSMLLFSASLLIGLFDIYCMASIYRHTSILTWMDNNTYVMFFGAMLTLGATIFFLLLKILQRIGNKLGIEIPSAPFPIRWKWQLWGIMAFSLIGRLLYQPFYEHYLTRTLYSQTSVTFPLSPIEVYYSIGPLRMTSWILATLAVLVCGYSLVKYLMGQTQQKSTESIFVYGGIMAIIAEFALRYVFYSIHYITISQLLKMTIIRGIISP

SEQ ID NO: 6735 - protein, 194 aa, Proteus mirabilis
QMNKQRCDWVTQDPEYLAYHDNEWGKPQRDKYKLFEMICLEGQQAGLSWYTVLKKRAGFRRCFFDFRPEKIALMTEKDVETLLQDPSIIRHRGKINAIINNARAFLAMEAQGEDFSEFIWQFVDGKPIDNQWQTISQVPAFTEISDDMAKALKKKGFKFVGTTTCYAFMQAVGMVNDHILCCFCRQSQPESSIK

SEQ ID NO: 6736 - protein, 259 aa, Proteus mirabilis
NGDKQQEDRMLLRVDNVSKYYYQKGARFFKEKVTILDALSFNIQKGEAFGLVGESGSGKSTLARLISGLELPDQGAIYLNDKPVTKRCYRQGVISIVFQDHIASVNPTFTVGEMIAEPIKLINPTLRHNELETIIFSFLEKVQLPKSCYQRYIFELSGGQAQRVCLCRALASYPQLIILDEAISSLDIPTQVEILDLLKLLKEELQLSYLFISHDIQTVTYFCDKVMFILQGQQIELCEINKLSTVTHPYAKKLIQSVI

SEQ ID NO: 6737 - protein, 231 aa, Proteus mirabilis
EMDNNKERFLSNLASQLGRPLKTQPEALPEPVNLYPEQRLTELSDDELYQYFLNTAQLAGSTYETTTLSSLPKHLETLCEQYGLPVILTGDPRLQESGVIDYLSEHCHANIWDHTEGKKNIERVKEAKVGIVFAEYGLAESGGVVLFSGADKGRSVGLIPETTIFVLKRSTILPRVAQLAERLHQMALKNIRMPSCINIISGPSCTSDIELIKVVGVHGSLNAIYVIIEDC

SEQ ID NO: 6738 - protein, 832 aa, Proteus mirabilis
IMRKSIIALSILGIIFSNTINANEIKRIKVGGYIIPPAFVNALEEGMSVPVFLRLNDANKQNQSEKKIADAIIVIDNDKIKLSSIQLIENNQGATLNQLLVDKIENKKNAIFNENNSITIDSNAVLQLNVSSFNLSLDVDKSAFAPKEHARQSILGNSSVNSFSAVANYDLGVFQSRVKNAQDSSSSYFNLDTLLAKAEHHFNINASAYSIGKSNSNIELYRAMYERDFNGLRFAIGLMSTWNLQSLASLTVLSSSKIYAASIGNNSSSRVVNKQQSLTPIYAFLNSPGEVRIYRQGKLLNIQNFPMGNFEVDTSMLPYGIYEVTIETVIDGKVVTTQHQTINKSFGTANGNFDQLNWEIYGGYIDFDKRHYIKEGGAYNQTPEKSYLIGSSFAYNFPVLSGIRFQMSNYGFDKFIVQETNISVAVNNYLSIAWQGMLENHGSHRNISTLSINIPEGYGSLWASKEKTIVRGDLPLYEADSYSYGGTVNFDKIMDRTGSFTISNTKDKRVGSDSINYEYANTLFSGRYGTVGLRAGVQRYHYDNQNSTNEKFINLDFSLPLSTWLSTGISSTNGNVKANIYVNKNFENSVITNAGVSVSKLVHDKDNGESDFSTLGYASYDTKYNSGTVTINRPDNKRLNGNLTSRGSIAYSEGMITPSGQQGKSGIIINSDIKGSGSMLAKVNGQNYPISGKNTFIPLSPYSDYDIQLMNDGKSKDSFDIISGRNKSVTLYPGNIAFYQPEVRQLVTVFGRLKSPNGELLKYASIRNHIGRTKTDQNGEFSMDVDVRYPVISLQQEDQQTICEADLDLKGAQGAMWVGEVTCQPQSSFVKR

SEQ ID NO: 6739 - protein, 515 aa, Proteus mirabilis
LMRNNQPVTQREYPVAENATLMSTTDVNGNIIYANEDFVEVSGFSAQELMGQPHNIVRHPDIPADVFRDMWKTLKQGEVWTGIVKNRRKNGDHYWVRANVTPIIRQGKIQSFMSVRTAAKKEEVEQAAALYAAFNQGKYPSHTFSKGAFIYKGWKSWRSWKQTLSLKQRVRLLLLLPFPFILLSVWFAGLNGWGLFIHTAILLSLLIANERIFYFQIVKPIMILNKHANRVATGDEHNVDYLDRIDEIGMTQRSVNQLGRMFRWLVNDVSHQIHQVAFSCDQLAAGNRDLYTRTEQTASHVETTASTMNQLTTAVSNNSETAGQANNLSNMTCKAAIQGGTAMDTIVHTMDDIAKSSERISNIIGVIDSIAFQTNILALNASVEAARAGEQGRGFSVVASEVRNLAQRSAEAAKEIKALINTSSNNIKIGSKQVNETVETMENIVVHVKNVTSLIGEISLASSEQSAGLKELGRAVEQLESITHENADYVSKASSISGEMKEQTNYLVKAIHVFH

SEQ ID NO: 6740 - protein, 376 aa, Proteus mirabilis
DESKDYLKKAVAMEKITVTLGERSYPITIASGLFHQPETFLPLKKGQQVMIVTNVTLAPLYLDKVTNTLEQQGVLVDSVILPDGEQYKSLTVMNDVFTALLEKNHNRDTTLLALGGGVIGDLTGFAAASYQRGVRFIQVPTTLLSQVDSSVGGKTAVNHPLGKNMIGAFYQPASVVIDLDCLATLPPRELSSGLAEVIKYGIILDKDFFIWLENNIDKLIALEPKAMAYCIRRCCELKAQVVAADEKETSGLRALLNLGHTYGHAIEAHMGYGVWLHGEAVAAGMVMAAKTAQDLGQFTQAETQRVIQLLKKANLPVNGPDEMQPEDYLPHMMRDKKVSAGKLHLVLPKGIGQSELRADISREQVYKAITSCINAN

SEQ ID NO: 6741 - protein, 97 aa, Proteus mirabilis
WWSNTNMARVTVQDAVEKIGNRFDLVLVAARRARQLQVGAKDPLVPEENDKMTVIALREIEEGLINGKILDARERQEQQEQEAAELQAVSAIAEGRR

SEQ ID NO: 6742 - protein, 216 aa, Proteus mirabilis
QILKKSCFALSPMHWQSRYVSLLSRLNSNQRSCKMRYADIRIETERLLLRSFAMKDAQEWFQIMSSPEVTRYWSHLPWQNIQQAKEDIIQDITHMERKEYLRLAIIDKATDKLIGMCVFFNHHLHSCRGEIGYCLDNAFQGKGLMYEAMIAFIDYLRTHLSIRRLEADIHPDNQASRALLTKLGFEQEGYLKQRWIVGDEVSDSAIFGLLLPTYIK

SEQ ID NO: 6743 - protein, 212 aa, Proteus mirabilis
LTVNWAYDNQPEQSTIEQDDMITITDAAQAHFAKLLANQEPNTQIRVFVINPGTPNAECGVSYCPPDAVEPNDTEIKFEKLSAYVDDISAPFLEDAEIDFVTDQLGSQLTLKAPNAKMRKVADDAPLIERVEYVLQSQINPQLASHGGRVSLMEITEDGYAILQFGGGCNGCSMIDVTLKDGIEKELLNLFPEELKGVKDLTEHQRGDHSYY

SEQ ID NO: 6744 - protein, 621 aa, Proteus mirabilis
SVYNNTLISTMPEANFVIENLRNIAIIAHVDHGKTTIVDKLLQQSGTFGERETVAERVMDSNDLERERGITILAKNTAIKWNDYRINIVDTPGHADFGGEVERVMSMVDSVLLLVDAMDGPMPQTRFVTQKAFANNLKPIVVINKVDRPGARPDWVVDQVFDLFVNLGATDEQLDFPIIYASALNGIAGTDYNDMADDMTPLYEAIVKYVEPPKVDLEGTFQMQISQLDYNNYLGVIGIGRIKRGKVKPNQQVTIIDSEGNTRNGKVGKVLGHLGLERIDVDVAEAGDIIAITGLGELNISDTICEVGAVEALPALAVDEPTVSMYFCVNTSPFCGREGKFVTSRQILDRLKKELVHNVALRVEETEDPDAFRVSGRGELHLSVLIENMRREGYELAVSRPKVIFREIDGRKQEPFEQVTIDIEEQHQGDVMQAMGERKGEMRDMQPDGKGRVRLDYIIPSRGLIGFRTEFMTMTSGTGLLYATFSHYDDVRPGEIGRRNNGVMISNGQGKAVAYALYSLQDRGKLFVTHGAEVYEGQVIGIHTRSNDLTVNCLTGKKLTNMRASGTDEATTLTPHIKQTLEQALEFIDDDELVEVTPQSIRLRKRHLSENDRRRAYRSKD

SEQ ID NO: 6745 - protein, 463 aa, Proteus mirabilis
RNNKGYKMRALYDSKSKTIDDRGIKALLSNEAKYSTWLMFEAMLAQAQAEHGFIPQSAADEIKEKAGIENIDFEEMNRIYQKIGHGFLPFLKVLVKACSQESGKYVHYGITTQNIQQSSQLYMMKTVHHKFMLLLGEIIENLANLAEKTKHMVMPGRTHGRHAIPITYGYKVSVWISDFIDCYQRMRECEKRVFTIMMGGAVGAFNSMPEVGMKVQKRVAELVGMEAMEVPSRNLSTHKLEYMANLALMANICHKIGEEVYSTTLEEIAEVSEGFTKGTVGSSTMPHKINPKLAKGIIANSQKLYSLPSVGMYSAVRPYEGDSSSYMLFDGLLEEALELTTEILLRTEELSRTIVPHEERMLHNVMRNKGLDNTEYVMMKMAEKLGKDKAHSLLYEEAIKTAADGEDFYTNLIKNPVISAAFSPEEIKAMLDPRAYIGLSVEIAEKEAKRGHVASQEIKQNYQ

SEQ ID NO: 6746 - protein, 415 aa, Proteus mirabilis
PLCNYHQETVMKNVAISGWELNLPSIVNFEQLSEQLLLKRTIKTEKYFSDDYFVEYFKFNHNPAVIPYQNIPNDHFEILTRLIDNSLKRANITLEKLRASRTIMYLAGHGPRADFMDYQGFYDKNDAEDVQYSPQIKSLHAASFAQDELANKLWAEYQLDFPPIPIYCASNSALMAVHIGHNEISQDMADIVIVLSWNSLLLQDIAFMDSQGMLVEAHAQPLSKYSDGVTLSDGYAVMILESQQQINSRQYLAPAYIYHSVFMQSNAERTMGGTLFNFYTISKVISQLLDLSHYLPSDIGAIFIHGNGSIISDKAETVAITNIFKQPIPIISYKGQIGYISNCSGIIDLMIIADSLKNNRLIPSTTHYPIDDGMEVNFLTNQECVNYSAKPILKIGLGMDGSIIAMLLIANGEQG

SEQ ID NO: 6747 - protein, 187 aa, Proteus mirabilis
RYSKRQSHSKIGAHKMTQNQLPLLGITAWSGTGKTTLLKKLIPLLRNRNIRVGMIKHTHHDMDVDKPGKDSYELRKAGAEQTLVASQQRWALMTETPDLAELDLYYLASRFDASKLDMILVEGFKTEAIPKIALYRHINERSVNELLDEHVIALASDSDLDTSLPLLDINSPEAIADFIIQWLTEKK

SEQ ID NO: 6748 - protein, 120 aa, Proteus mirabilis
TPLNHVINQIIILRRTLMNPNIYQEIENNPRFKELVKKRSRFSWGLSIITLVMYVSFILLIAFYPQWLGTPLYEGSYITRGIPIGIGLIIASFLLTGIYVIRANTEFDKLTAEILGEVEK

SEQ ID NO: 6749 - protein, 448 aa, Proteus mirabilis
CQVKSISFYNVEIYFPIRITMSFQEQQITFDSRHHQLTNINVWTPDSQWLVYDVRPNGGSFTGLTIEKIHAKTKQQQIIYTATQGAHVGVATISPVAPVRYAFIHGPENPDDLWHYDFHHRRGVIVNEQEDLGAVNIDACSLTSPYQAGALRGGTHVHVFSPDGTRLSFTYNDHIMHELGREFDQRNVAIAVPLKAVKVAKKHPREYDGEYFCTLISQTVAYPQKGSDEINKAYEECWIGKQGYTKADGSQQRWAIAFIGDTVSESGEKVADIFLVDLPDDDHAFSLEGDKPLAGTETTMPAPAQGIEQIRLTNTHHRKYPGVLNQPRHWLRSSPQGDAIAFLMKDDDGVVQLYTVSPTTKAIRQVTLQQWDIQSAFTWSHRGEYLTFICDNSVMLCNAKTGELTRLTDKTAQAPSGDAVVFSPNDQYIAFMRDIDGYRQIFTVESGL

SEQ ID NO: 6750 - protein, 225 aa, Proteus mirabilis
CSPNFIGRGSKSMSKFIVYPAVSSKQLGFYIDSARCSGCKACQVACKDKNNLDVGRKFRRVYEITGGGYSRNTNGALINNVFAYTLSISCNHCDDPICVKNCPTTAMHKREGDGIVMVDTDKCVGCGACAWSCPYGAPQMDPETKQMSKCDFCIDLQQKGEQPVCVATCPLGAIQFGPIDELRERYGEVNYVTGLPSPEITHPNLVINPHQGANNDTINNKGEIK

SEQ ID NO: 6751 - protein, 222 aa, Proteus mirabilis
GSTKMNRILTLVFVAFAFVLSGCAEPVKTDYTAFKASKPKSILVLLPKNQTPEVEAAHSFLSQVTYPLAEAGYYVFPVAVVEETFKQNGLSTGSDIQAVSPSKLREIFGADSVLYLDVTQYGTSYQVIASETRVSASAKLVDLRNGALLWSGHASASSAEGDTASNGLVGMLVSAVVTQIVDTIADKSHEIAGVASVRLLSAGHANGILYGPRSPHYEKEGQ

SEQ ID NO: 6752 - protein, 474 aa, Proteus mirabilis
PMQKGNIWVVDDDSSIRWVLERAITREGLTCKTFEHANDVLSALNSELPDVLLSDIRMPDIDGLSLLKSVKEQHPTLPVIIMTAHSDLDAAVNAYQQGAFDYLPKPFDIDDTLALIHRAITHYREQKQPNTTETNLQSVSDMIGEAPAMQEVYRIIGRLSRSSISVLINGESGTGKELVAHALHRHSPRAQAPFIALNMAAIPKDLIESELFGHEKGAFTGASQVRQGRFEQANGGSLFLDEIGDMPLDIQTRLLRVLAEGQFYRVGGYAPVKVDVRIIAATHQDLEKRVMEGDFREDLYHRLNVIRIQLPPLRDRTEDIPSLARYFLQKTARELGVETKVLHQQSLHCMMEYHWSGNVRQLENVCRWLTVMTASQEIMPQDLPQEIRQSDEKSKSIPRVSSQHWSQHLSLWADEVFSEGKENILNDALPQFERTLLLSALSYTKGHKQDAARLLGWGRNTLTRKLKELGIEEF

SEQ ID NO: 6753 - protein, 65 aa, Proteus mirabilis
YVKNNHFSIFIIFNHFIFNRLIFIYIFIFGVLNYVEKYCYQSFFTSYHFFGFFSHTGRKRITTEI

SEQ ID NO: 6754 - protein, 493 aa, Proteus mirabilis
VSKKFTKKCVRPLHLIKPFARRVTMSLEHVLSMIEEHKVRYIDLRFTDTRGKEQHITIPAHQVNDDFFEEGKMFDGSSIGGWKGINESDMVLMPDATTAMLDPFFQDPTLIIRCDVLEPGTMQGYDRDPRSISKRAEDYLKSSGIADTVLFGPEPEFFLFDDIRFKNDISGASYAINDIEAAWNTNTQYEEGNKGHRPMVKGGYFPLPPVDSSQDIRSTMCNIMEEMGLVVEAHHHEVATAGQNEVATRFNTMTKKADETQIYKYVVQNVANVFGKTATFMPKPLVGDNGSGMHCHMSLSKNGVNLFAGDKYGGLSEMALYYIGGIIKHARALNAFTNPTTNSYKRLVPGFEAPVMLAYSARNRSASIRIPVVASMKARRIEVRFPDPLANPYLAFAAQLMAGLDGIINKIHPGDAMDKNLYDLPPEEAKEIPTVAGSLEEALNALDNDREFLTRGGVFTDDALDAYLELLRTDVQRVRMAPHPLEFEMYYSA

SEQ ID NO: 6755 - protein, 195 aa, Proteus mirabilis
LLKNQNITAGILAGGQATRMGGADKGLQLLHGLPLYLHIAQKLSPQVASILISANRNLERYRQSQYPVITDETSDFSGPLAGMLALLKQAQTPWVVFVPCDVPYFPSNLVETLYRHKGDALAVYADDGQREHPTLALLNRCLIPTLEAYLAQGDRKLMLFMRQIAAKPVLFANQAAAFINLNTPEDIANANHIAK

SEQ ID NO: 6756 - protein, 81 aa, Proteus mirabilis
IEKKDPLINRRTDPMSATRKRFIAGAVCPHCQAQDTLKMWREDKVDIVECAQCGHQQRQTDGEVSALVRENEQVIGIFTPQ

SEQ ID NO: 6757 - protein, 136 aa, Proteus mirabilis
IREKLTFPCKCKRFSHLRISYSREGIMFSVIVIFWALCILCLINMMRYFSSIRVLLTILRQSDPLLYQSVDGNGFFTMHGQFSKQLRLIRYINQRQYTNHHDPEVIMRCERIYRQFYLVSRFCILAVASLIAMIIW

SEQ ID NO: 6758 - protein, 334 aa, Proteus mirabilis
SRENCPYSLLYIFRLEGILKPFFLFYVSPCGYNMQKFDTKTFQGLILTLQDYWARQGCTIVQPLDMEVGAGTSHPMTCLRALGPEPIAAAYVQPSRRPTDGRYGENPNRLQHYYQFQVIIKPSPDNIQELYLGSLRELGLDPTIHDIRFVEDNWENPTLGAWGLGWEVWLNGMEVTQFTYFQQVGGLECKPVTGEITYGLERLAMYIQGVDSVYDLVWCDGPLGKTTYGDIYHQNEVEQSTYNFEYADVDFLFSCFEQYEKEARELLELEKPLPLPAYERILKAGHTFNLLDARKAISVTERQRYILRIRTLTKAVAEAYYASREALGFPMCKK

SEQ ID NO: 6759 - protein, 77 aa, Proteus mirabilis
QGEKTMDIKEIEELLIQLESKIAFQDATIEELNQVVTQQQIEISRFKEALKIVTERLKSSQSSMLARPEDETPPPHY

SEQ ID NO: 6760 - protein, 436 aa, Proteus mirabilis
LMENIIIFISIFILIVLLSSSLSWFYIKYTLWLLYITLSHFYRNLCFIVLLCVAISILEGFYHHLTLLLKEQVAYSNLGHIEIYKKDNKQDITDKKDYLEITNAEEIIHLLTYDKQLLEKIQVISPQIIFSGMIENVINKKAVLFSGLAIEPKSLLTIGAYDLTVSGSELSHVRRTEITIDKFIADAININYGDLVNVVFIHNNEKMVLPTYVRGIFNTQINSYPYAMIKIPLETLQYIKKSKSVSKINILLKNVHDIDSVIAKITRINKEKSLNLQVIPVIERQSYIISIVTFFKWSMLLLYSIIAIYYYFLVNKIIIITIKKAIGDLFEFNRLGIWRGSFSRLFILLAIFMTITISITILLIHQLLSWLINLKQINISLSDNNSYSLMLPWLWQYDAMFKIPLLLFFSATIASCISIFKVSHYLQKYQKNNITI

SEQ ID NO: 6761 - protein, 567 aa, Proteus mirabilis
NRRKVMRWLIKSLVSLILIVILFIIVIYAFLQTQWGAQKTSEWLTQYSDYDIRFSGIEHDLTQPEQIVVYDLSINPKQDKTAVLAQSAQLRFNWQFFTMPSHLQKITLENGKIILANKIAPLPVSADILQFKNMQLDSMPTSSTTFTFSANKITGGITPWKPTSTDPIGAGHFQFSIADGMIGKNSFNNFIVAGEYQPNRILIEKLATQFLNGSLSLSGQYQDNQWQLNDVYLTGLRWQSTKTLEELQQSLSQSPAMTIKQLNIVDFTAEGKQWAISGFAGQFSQIAWNNSLSLTSGELNTDDIVYKNQHVTDVIAKLNQQDNLFNIDNLSLRYEKGLIKLAGQWNSETKTLNIEDATLSGILYTLPEQWLSFFAKPIEQDVKSINIKQLSLNQSILIDINPLFPFQFTGLTGQLKNLIIAKDGQWGLWQGAATLSADSGTLNGVELRRPDLTLMTQQDTAIIPQFSAFVDKGIVRGSAALEQNNNQRLFSLIVNGLNVPLSLPNNMGWKLSQPTDGTGQFTLKLKGNLAADAVIPTLNGTLIGKKDDQTPIDDRMQDGEIINNLSF

SEQ ID NO: 6762 - protein, 196 aa, Proteus mirabilis
EVTLMSLYNQSLLPPTLFLKLGAWRQPTIMVDRIVDFVPSEKPIIKTIKHVTFNDPYLLGHFPTDPVMPGVMVAEIFGQTSEYLSFIDDFCSIYKIEHNIELTTFKEIAKALNEPRSERILIQHRRKVSGVLASQNLRYKNAAYPGDTIEITSILLFSDKSNFKHYSVEARVGKKIIANGTIVNFREYNHSEQNKN

SEQ ID NO: 6763 - protein, 143 aa, Proteus mirabilis
IMLKNIAISLSLLLITSSAFSATLAERELQQKFEENIQSRVVDLNKSCDANIKVAFDWSAFTVEDLKTTGIDGYCSEGLKGVINTCESSKIAQETVKEKIQNITCSKASPRSIELKDGTLNFGIDFNAANDANAIQTHLMNNL

SEQ ID NO: 6764 - protein, 373 aa, Proteus mirabilis
NIMKSVFFYLLLLLSILCFAGFAQSRDPFYPEQPIDSNNTHHFIDKTDNSETLQHQNSTLHHRIYPLQYADVTTVAQQLTNYGISLLSDHGRIAIDKDSNSLSIIDTEKAHTEISDWLKIKETPQQQVHITAHIISSSQDALNELGTQWGLLNMKSANLEGTSNNTTTPHNIASAPLTAPSLAALALHQKTKNPLHYIAFNIARINSRLLELELSALEQEKQLAIIASPRLTAAHEKTASIKQGTEIPYVSRDNDTIRVEFKEAVLGMEVTPIIQRSNKIRLLLKISQNTPGIALVQGGSEHLSIDKQEIMTEVTIHDGETLMLGGIFQQKQQQHAAKIPFLSSLPLLGILFSHKRDQHSRHELVIFITPKLI

SEQ ID NO: 6765 - protein, 209 aa, Proteus mirabilis
YEMKKIWLALASMVLAFGVSAADISEGKQYTNLSKPVAGAPQVVEFFSFYCPHCYQFSEVYKVNSTVEKNVPENTKMARYHVDFLGPLGKEMTRAWAVAIALGVEDQVSPALFKGIQETQSIRSVDDIRTTFINAGVKAEDYDAAINSFVVNSLVSQQQNAVTDFQINGVPAMVIDGKYKMKNDGISAKSPEEYAKAYSDVVNQLLMKK

SEQ ID NO: 6766 - protein, 198 aa, Proteus mirabilis
RKMNDDVDRCPECQVRAYYTDDFVRVYQAYSTTIAQSAVANGTFVSPPFSMTRMTWVKPSFLWMMYRSGWGRKDPNQASILAVDITHEGFQQMLTQGVVSHFDPDHYVSAKEWQEATETSDIRIQWDPERDIYLNRLSYRTIQIGLRNQAVEKYCNEWIVNITDITDKVRKIDTCITNGDLDTAYSLLPIEQPYHFAK

SEQ ID NO: 6767 - protein, 803 aa, Proteus mirabilis
ILAKSLITKNNSLFINYSGNTTTGITIMTPLTIGLIGNPNAGKTTLFNQLTGSRQRVGNWAGVTVERKVGRFTTKNHKIELVDLPGTYSLTTISEQTSLDEQIACHFILSNEADMLINVVDASNLERNLYLTLQLLELGIPCIVALNMLDIAEHQNMQIDIQALSEQLGCPVIPMVSTKASGIDKLKDTIDSFPATKRKPEELLTSYPTWLLNEVESLAEKINHDEFNLQQRRWMALQCLEGDIYTHQRAEITSQEIKAIRQRIQTEHSNEPELVIADARYQNIERICHAVINMESIKPNQLTQNIDKVILNRWLGVPIFLFVMYLMFVLAINIGGALQPAFEGGSEAIFIHGIQWLGATFNFPEWLTIFLAQGVGGGINTVLPLVPQIGMMYLFLSILEDSGYMARAAFVMDRLMQALGLPGKSFVPLIVGFGCNVPSIMGARTLDAPRERLITILMAPFMSCGARLAIFAVFAAAFFGKNGASVVFSLYLLGILVAILTGLLLKHTIMRGEASPFVMELPVYHVPHIKTLLIQTWQRLKGFVIRAGKVIIIASMFIGALNSFTFSGKAADSINDSALASVSKVITPLLQPIGVHNDNWQATVGLVTGAMAKEVVVGTLNTLYTAESIVNEPFVPEEFDLWGEIGDAFAETWDSLKETFTFAALSNPIEASKGDGEMDTGTMGTMGSKFGSAIAAYSYLIFVLLYVPCVSVMGAIARETSRGWMTFSILWGLNIAYSLAALFYQTATFSEHPQSSTITIAAVLIFNLIVFVLLRKSRHRLSFNLSNKRSLAKQCCGKQGSCH

SEQ ID NO: 6768 - protein, 465 aa, Proteus mirabilis
DKAKNIFFWDLLSMSMSSPNSAPQSLLQRLFKLQEHGTTVRTELIAGVTTFLTMVYIIFVNPQILAAAHMDIKAVFVTTCLIAAFGSILMGLVANLPIAVAPAMGLNAFFAFVVVGAMGYSWQVAMGAIFWGAVGLFLLTLFRIRYWIIAHIPLSLRVGITSGIGLFIAMMGLKNSGIIIPNNDTIVTIGNFASHNVLLGALGFFIIAILAARNIHAAILISIIITTVIGLLLGDVQYQGIFDIPPSIAPVVGQVDIVGALDIGLSGVIFAFMLVNLFDSSGTLIGVTDKAGLTDDKGKFPRMKQALYVDSLSSVAGSAMGTSSVTAFIESTSGVSVGGRTGLTAVVVGILFLLAIFLSPLAGMVPSYATAGALIYVGVLMTSSLTRVKWDDLTESVPAFITAVMMPFSFSITEGIALGFIAYCVMKVGTLRWKEINLCVVIVSLLFILKILLIDTHVIDLNNLF

SEQ ID NO: 6769 - protein, 349 aa, Proteus mirabilis
QQWNRTNMTTSVEKKAQKPIVFSGAQPSGELTIGNYMGALRQWVQMQDDYDCIYCIVDQHAITVRQDPTELRKRTLDTLALYLACGIDPEKSTIFVQSHVPQHAQLGWALNCYTYFGELSRMTQFKDKSARHAENINAGLFDYPVLMAADILLYQTNQVPVGIDQKQHLELSRDIAQRFNAIYGDIFTVPDPFIPKGGARVMALQDPAKKMSKSDDNRNNVIALLEDPKAAAKKIKRAVTDSEEPPRVAYDLENKAGVSNLLDILAGVTGKTIPELEAEFEGKMYGHLKGAVAEAVSDMLTNIQERFNTFRNDEALLNKIMKEGADKAKARAQTTLDKVYEAIGFIAHP

SEQ ID NO: 6770 - protein, 666 aa, Proteus mirabilis
QLFDIVLTTVRRTIMTKINQHHIPANIAEHALINKEQYQKDYALSIENPEAFWADKGKIVDWITPYTIVKNTSFDPGHVRIRWFEDGQLNISQNCLDRHLEKRADQVAIIWEGDSPNESKSITYRQLHQDVCQFANVLKKLGIKKGDVVAIYMPMVPEAAVAMLACTRIGAIHSVIFGGFSPEAVAGRIIDSKAKLVITADEGLRAGRAIPLKKNVDDALTHVDIPPIEHVVVLRRTGQTEQWIEGRDLWWDEIVQGVSTECDVEVMNAEDPLFILYTSGSTGKPKGVLHTTGGYLVYASMTFKYTFDYHDGEIYWCTADVGWVTGHSYLLYGPLSNGATTVMFEGVPNYPSVNRMAQIVDKHQVNILYTAPTAIRALMAEGDKAIEGTQRTSLRILGSVGEPINPEAWEWFYQKMGRSQCPIVDTWWQTETGGFMITPLPGAMDLKPGSATRPFFGVQPAIVDNMGEIQDGACEGNLVIVDSWPGQARTLFGDHDRFEQTYFSTFKGMYFSGDGARRDEDGDYWITGRVDDVLNISGHRLGTAEIESALVAHPKIAEAAVVGIPHNIKGQAIYAYVTLNHGEEPTAELYTEVRNWVRKEIGPIATPDILHWTDALPKTRSGKIMRRILRKIASGDTTNLGDTSTLADPGVVEKLLEEKQSLSLTI

SEQ ID NO: 6771 - protein, 560 aa, Proteus mirabilis
MRIELSILIYCILWCCAFFSVANESHIDPPVPVDLPTETQLRDQLLQQNDNVSLVNLAPQNKREFITPSVHCFSIKQVKLHHLDEFSSSSLQRQVAKWQAELVGHCQSQALLEQDINILNALLYDAGYVTSEVGKVDLYADDEVLDITLNVGRVQDIVSEAPTDKRYLISQAVPVKKGDVLNVKDIEQGADNFRSRPNSNVKIQIEPSSKEHESIISLSQVGKRTMAGSVSIDNKEQKIYGDLFGTTRLSFGNLAQLNDTLMVILSSQLDTLKSRGIKKQIFLWQVPYHYWRVTLFGYDIGSKMRVSEVTKELQKTRQQLLSFEIQRQFRPSTQRTVTLSGGIQYYTYRNEVSGYRLSVHERRSPYINAGIEQNYRFMRGGFLNTKFHYKQSVFIPGARLSPIDSLNGVPIFNLNFDALIPFKITSQQFFYQPEMIFQLTRSDIDGLLDKATIGGLYSVYGFESGKGYSDANQFVSRHKVTWLTPLNNQMLFSAIDYGSVSEDRKKIFYNKNKYLVGAAIGLEGSFKKLSYQLVWSIPLSAPSSREATGSQFNFNTQFNF

SEQ ID NO: 6772 - protein, 88 aa, Proteus mirabilis
VVPEVNSWGLNPSGEPSEQYTNVFACTPAEIAKASKPIVAVSNPVCFLELLIIILRHYSVVFFGFLFKNGIPFYFVIVQLTNCIRFRQ

SEQ ID NO: 6773 - protein, 325 aa, Proteus mirabilis
LSLFDALTEGIMDEFKPENEIKSGDNSLKPDTSDRPERRTNRPRNNPLKNARFSVSRQQMMIGVGVLVLILLIIAISSALKSPDSDKETTASTTGTEKNIELSQPSVTSTDNQTSTPQELTGQQIQQPTTQPSQNLPPMIDSQGQRVEIPGDIVDSLNQQQAGVNQAVNQQQQNTQNQPTTPQTPVTKPQPAPTQKPEVKPTPTKPVTPPATTQTKPVAKPTTKPVASGALSANNLAAIPATNYTLQLSGASRQDTLEAFAKKNLNGNYAIYKTQRNGNPWYVLIYGNYRNISEAKQAVASLPAAVQAKKPWVRPMKHVHQDLKK

SEQ ID NO: 6774 - protein, 233 aa, Proteus mirabilis
SIFDSLCKTHLSMHEEAHYFREAYTIMTQFNYQKAHFIISAPDIRHLPPDTGIEIAFAGRSNAGKSSALNALTQQNGLARTSKTPGRTQLINLFQIEEGRRLVDLPGYGYAQVPEEMKRKWQHSLGEYLQKRECLKGVVILMDIRHPLKDLDMQMIDWAVDSELPTLVLLTKADKLASGARKKQLMAVQDALSEKSGDIRVECFSSLKKIGIDKLRNTLNEWFTDTNEPETEA

SEQ ID NO: 6775 - protein, 542 aa, Proteus mirabilis
KDNENFIMNSKIFFLLVAPCLLNLSLSTTSQAATVTNSYVFIENNVDNEYFITPRTTDPRFSGANKYTRYSKSSQLSLGYMGYTNTSIQANQYVDIWLENSQIDKPFVGNRCMRRYCNDDSGYWPAQYIGKDGAYKIVQTNTNGESAYARGIFSDSAYLYFRQLPVGTIETYSYRACMTKTDYDPSKGGSCQSVGGRMLASHEFNITKSGHITLTSTGALQEIFIDSNGNPTIGLGSQFCRVGIVSNQNGIICQVIDHETTGDIFTNIRLNLKINNTLIPFTPAANTIKIGPDDGSNNWYNYNTTYPANYYFKVNNKNVSIFLSNTFLKRLVSSNVDFKNSQDFFTFSFTNTAVPQSGYYEFTPSNTLILKPRDYGISIIPADFNPHQSKTGKVGNEEPPIEFNYIVTTSGPRQADSITASVEGPQTTLKGQSYCLFSSSDNRLNVPFPAYLSFKNSDGTDAKYRASCDSHEISLKNALWTETPWDRPDEDLGSFYRTNLDLSFPMNDANSFFTLDGIDWLGTVSASGTVTVKAIWTGPDIN

SEQ ID NO: 6776 - protein, 82 aa, Proteus mirabilis
KGDELEGDALMGYCIHAANCSFLDDIHQSKALLYDLQARYLCRHQPRTWQIANEKAAPYKYNQVLLSYHRYIACLNTQGEMK

SEQ ID NO: 6777 - protein, 108 aa, Proteus mirabilis
NGLELIMKTINEIANLIAEQRKKLGIEQKDMYLRIGMKQQQYQRIESGSDLKLSTLLRVLEGLDLELSIKAKNSNINPMIASTVIANKSEIDLKDDGDDLDFWFKTEE

SEQ ID NO: 6778 - protein, 93 aa, Proteus mirabilis
DLLEISEQLKMASEKGDWNPETGIFKFSLEVQSQLVNTYSAFGAHPNSRIGIEDLYWYYQVNPEVTTPMRYINWGGDTQENNRLLGFINSENI

SEQ ID NO: 6779 - protein, 68 aa, Proteus mirabilis
RVIDKNLLGGHSAVVPPDPMPNSEVKRRSADGSVGSPHVRVGNCQALNKTRKPTQWVGFFAFILFRLR

SEQ ID NO: 6780 - protein, 182 aa, Proteus mirabilis
FLIDCATNKITNRVTIMNMIKRKPAAKTRKKTREELNAEGRERKRQKKHRGNPAGNRQQEAMKKEQAQTNEQKDPRIGSKKPIPLIVDNQAPKVDKKKSAPTKMEPMRLSLEEELALLENDTRLDELLSRLEEGGKLNPEEQAYTEKTLDRIDALMAELGIEFEEDDDEEKTEDIMQLLKGK

SEQ ID NO: 6781 - protein, 122 aa, Proteus mirabilis
MGVEMITCKRVYDDKDGKHEGYRVLVDRLWPRGVKKSDFHYDEWNKALAPSTELRKWFHENGDFTQFTARYIKELEAIPESWQPLLKVAKEKPLVLLYSAKDEKQNNAVVLMEFLQKQCKTS

SEQ ID NO: 6782 - protein, 412 aa, Proteus mirabilis
VVRDNQERDIIVGSFDTVIIGAGAAGLFCASLAGQAGLSVLVLDNGKKAGRKILMSGGGRCNFTNMYIEPSAYLSDNPHFCKSALARYTQWDFIELVQKHHIAYHEKTLGQLFCDDSAQQIVDLLLAECHEGKVSIRLRSEVTQIEKTAEGFTLLVGGKTITASSVVIASGGLSMPGLGATPFGYKIAQQFGLNVLPTRAGLVPFTLHKPQLEQLSPLSGVAIPAIVTAENGTQFKENILFTHRGLSGPAILQISSYWHAGENVSINLLPDTDLEGYLQEKRQAQPNQLLKNTLSRLLPKRFIEIMIENNQLPDTSLAQLSNERITQITTLLQAWLVLPNGTEGYRTAEVTLGGVDTRNLSSKTMEATKITGLYFIGEVVDVTGWLGGYNFQWAWSSAYACAQALISRHMTK

SEQ ID NO: 6783 - protein, 159 aa, Proteus mirabilis
GRGDPDMTKINTIIGAISVAFGLLIIYLSRDMSMFDEYGVPGERFWPYGLAILFILLGIFQWIGVVVDKIKHVHQSVDLSSTAVKRAYGLGIFMLLYATGLYLFGFIVPSLLLIPIIMWLMNERKPIAMVVIPIVIVAAVYVFFDIIFNSPLPTSVFFE

SEQ ID NO: 6784 - protein, 255 aa, Proteus mirabilis
HKLENGMKSLLKTTLLATSLAFAFSAPHALAEETAKVPTLNSAFKTQDEQNAYALGASMGRYMEAALTEQKNIGINLDSKQLLAGVQDAFNNKSKLSDAEIELTLAAFEDQVRTVATAKMEKEAAENKAAGDKFRTEFAAEKGVVKTKSGLLYLVENPGKGKTPTDADRVTVNYKGMLIDGKQFDSSYDRKEPLTISLKSVIPGWTEGMKYIKEGGKIKLVIPPELGYGQRATSGIPANSTLVFEVELLSVESDK

SEQ ID NO: 6785 - protein, 247 aa, Proteus mirabilis
DMLDFLKNYDNLTVSEKKVLKYLTDNIADIPYLNINDLVAKTFVSKTVIINLSQKLGFSGFKELKFQINNYILSRNKIEKSDHSSYKKQLEKNINKSFTLINEEQIKECAKTLRHSRNIFIVARGTSKAVGYYLEHLLFALGLHCFFINDYNLSDSFTRLVNEDDTVIFISLSGGTKKIIETAKIVQLKEANIISMTAFNTNELTSYATHTLFCFADNHDTKKDDTKSRIGFFILVDLLINEIENLL

SEQ ID NO: 6786 - protein, 65 aa, Proteus mirabilis
WDQLIFNIKLITHRENRKMLIKETTNEYKDKIRHILSIILAIYLKLDKSRLRQKTKSIFYINKII

SEQ ID NO: 6787 - protein, 93 aa, Proteus mirabilis
GFFCMNCHRLNEVMELLHPVWEEHSDLNLVQLLQKLADEAGFKGQLADLTDDILIYHLKMRNTAPTDVIPGLKKDYEEDFKTAILRARGVIKD

SEQ ID NO: 6788 - protein, 94 aa, Proteus mirabilis
KRKLLFNPFWYLLSDKKTNNLGTYYYNSASINRWYVFDQMIFSSSFLYGKEDCFKLDLEQLDFYRVLNDDNHCLDDIFFKKFDHYPIFCRIFHE

SEQ ID NO: 6789 - protein, 460 aa, Proteus mirabilis
QHDCAVWEYFMSHKLKVVTIGGGSSYTPELLEGFIKRYHELPITELWLVDVEEGKEKLDIIFALCQRMIKKAGIPLTIYKTLDRREALKEADFVTTQLRVGQLKARELDEAIPLSHGYLGQETNGAGGLFKGLRTIPVIFDIIKDVEEICPNAWIINFTNPAGMVTEAVYRHTNFKKFIGVCNIPIGMKMFITDVLKLTEQDTLSIDLFGLNHMVFIKDVIVNGQSRFPELLEGVASGTLTAGSVKNIFDLPFSEGLIRSLNLLPCSYLLYYFKQKEMLAIEMGEYYKGGARAKVVQQVEKQLFELYKDPHLNIKPKELELRGGAYYSDAACEVINAIYNDKQAEHYVNIPHHGHIDNIPADWAIEVTAILGKDGAKPHPRLTHFDEKVLGLIHTIKGFEIAASQAAISGEFNDALLAMNLTPLVLSDKDAEVLTREMLLAHKAHLPNFAHAIAQLAASN

SEQ ID NO: 6790 - protein, 504 aa, Proteus mirabilis
PLRLYMIKDYKRWIVLLLVSSMLFLIVVDVTVLYTALPRLTHDLNASASEKLWIMNAYPLIVAGLLPAAGMLTDRIGHKTLFISGLPLFAIASLCAAYSPSATSLIISRGFLAVGAAMSMPATLSIVRQVFTHPQERAVAIGIWSAVASGGAALGPLIGGLLLNHFWWGSVFLINVPIVLLVLPFSIWLIPHFSGQRQHKIDYLSSILILIGLVSAIYTLKEIGKAYTQWNEVIIATLIAIIFLTLFARRQRRQTHPMIDFSLFKKRYFSVGVAMSTLSMVIIVGIEFLLSQRLQLVAGFTPLNAALVILPIPIGSVLASPLAGFWLARLGAVRLIIIGFALTLMGNLWLIAISNSPIMLMGSLFLIGFGLGIIFTTASTSIMLSVDDKQAGMAASIEDIAYELGSVIGVTFMGSLMSTLYTLKLTLPDTLNVNSVVYDSLDEALIVAEKLPEAAATLLIAQANSAFEYAFSIVLIATAIVTTISLIALPYCLRNAVRENKPSH

SEQ ID NO: 6791 - protein, 694 aa, Proteus mirabilis
CMPCHCKPRYRMFFMSNPLLSTTGLPAFSQIEPKHVVPAVKEVLANYRATVEKLLADNTAFSWDNLCQPLAEAGDKLSRVWSPVSHLNSVKNSAELREAYEQSLPLLSEFSTWMGQHEGLYQAYKSIKESADFALLTQPQKKAVENALRDFELSGIGLPKEKQQRFGEISARLSELSAKFGNNVLDATMGWSKLITDESELAGMPQSAIDAAKAMAQAKEQQGYLLTLDMPSYLPVMTYADNRELRKEMSIAYSTRASDQGPNAGQWDNSEVMAEILALRHELAQLLGFKNYAEKSLATKMAESPEQVLNFLTDLASRAHPQGEKELAELTHFAKTHYGVEKLEPWDLAYYSEKQKQHLFSIDDEQLRPYFPEHRALSGLFEVVHRIYGLTAKERHDIDTWHDDVRFFELYDESNTLRGSFYLDLYAREHKRGGAWMDDCIGRMRHADGTLQNPVAYLTCNFNKPVGDKPALFTHNEVTTLFHEFGHGLHHMLTQIDTADVSGINGVPWDAVELPSQFMENWCWEPEALAFISGHYETGEPLPQAMLDNMLKAKNYQSAMFVLRQLEFGLFDFRLHAEYDPAKGARIMEILNSVKEKVSVVPATPWARFPHAFSHIFAGGYAAGYYSYLWADVLAADAFSRFSEEGIFNRQTGQSFLDNILTRGGSEEPMELFKRFRGREPKLDAMLKGYGIKG

SEQ ID NO: 6792 - protein, 345 aa, Proteus mirabilis
GLPCESDEKRNGLMLLSPNPLYKAYWVAQCRYTRNGEQFKGVMTVAGTSQSQAIKQMRQYFTAHPGEYTFADYDTLIPLITHIEQSSTLELPLIRQVREQHNAKVSAVLVDKCNLTHPRPSEKGDIHYREGQPTFIEYSHLYVVIDSGEYHRQTGQHLVPKLHGSQLPWKSLYQGETQDSLEDKAPYLVHIVANQAGQRFLAHYLNLPHKASLGLFINSLKPFTDIHRQMRKLTYLYNQKLESWNFFRFYDVKHFIPFIESLTHGQLINVVNGVNAFYGYSAQYPDGVEITFHPDYLYDGSKREPLFINTYLYNHYANITQLQTVAKAKALIEQFSQVERGRVRG

SEQ ID NO: 6793 - protein, 249 aa, Proteus mirabilis
TGHRDLYTTIIVGFFDITRYRRFIFRYNRENFAHGYVGDVMKVANDLVVSLAYQVRTEDGVLVDESPVSAPLDYLHGRGSLISGLENALTGREVGEKFDVEVASDDAYGQYDENLVQRVPKDVFVGVDELEVGMRFLADTDQGPVPVEITGIEGDEVIVDGNHMLAGQNLKFHVEIVAIREATEEELAHGHVHGEDEGHECCGGHGHGEEGGCCGGGHGHDHDHGEEGGCCGGGHGKGGHGHGGCGCQH

SEQ ID NO: 6794 - protein, 193 aa, Proteus mirabilis
ANMLLLIDNYDSFTYNLYQYFCELGAEVVVKRNDEIGLKEIEKMMPSHLVISPGPCTPDEAGISLEAIQRFAGEIPILGVCLGHQAIGQAFGASVIRAREVMHGKNSLIHHNQQGVFKGLNRPLSVTRYHSLVIDATTLPVPFEVTAWSQHDGNVDEIMGIRHRTLPIEGVQFHPESILSEQGHELLNNFLKY

SEQ ID NO: 6795 - protein, 527 aa, Proteus mirabilis
HVFRHLLLNLISGLIPRINKTEVHMQGAMTRILLGSVMFSAAICQVQAEALQPDPAWQEGRLANGFQWQILQTPQRPNDRIQIRLLVNTGSLSEKRSETGFSSLVSKLNVLENTGLTPEKRDNLWKNAFDPDYPLPPMIVSYDFTVYNLSLPNNQPELLKDAFALLAGIAKPAQYTEDAVRNAIQSPLPVVTFPANIDDPIWRSRLEGSNLKGHNPGKPVNHSVNTKELSDYQQRWYTPDMMTLYIAGNVDNRILTESINQAFSSLEGKRVTPVPVPVLADMKPETLYVQEPMRKNDQISLIWDLDWSPVKDSDTLSRYWLSDLAREVIFVHLGRSLEQRKEKESTQVNIDCRVQYQRASCSLNVDTATANIPALATWVGEELGELRNQGVSDELYQDLLQEKQIQLTQLFARYAKTSTSILINQRLLSQQSNIIDIPPEQYQRLRQAFLAGLTKEMLNQELSRILSEDITFVLTQSSETPTVNLGELRVQFEKQVHPETANSSNRAKTSLTTGEKASVQADAQQTK

SEQ ID NO: 6796 - protein, 97 aa, Proteus mirabilis
AMPRVCSSDAAKISFIEPDTWLTDVTISPIDKLTCSTRSLPCFTRKIVDSMSSFISFAASALRCAKLRTSLATTEKPRPCSPALAASTAALSANILV

SEQ ID NO: 6797 - protein, 76 aa, Proteus mirabilis
PITRRRGHGNTPFKIQGCPKLDEFILTLIVKKCLALLNGEPLSLWLLHTVLRATLFTVFNTGTVQRAANSVVTHTW

SEQ ID NO: 6798 - protein, 61 aa, Proteus mirabilis
VYQRIIRTHLFMLMHNHMKILLLDMKVYLGITFVQECQVIVLVKTFKISQQKVMWFLIFHQ

SEQ ID NO: 6799 - protein, 452 aa, Proteus mirabilis
WNERIIMRRLRLSPHNKLTRSLFLVILLLFFSLIASYVVVQHLIVGPSLQQFNKVLAYEIRTLVPEELILVDGTPLKISPALRNKIYNELGISFFDKDAALKAGLEWAREDLELSQQMTDYLNSDTTIWLENTLEYPILWINTQLSPTLWIRVPLTELGQNFLLPVYRQAIIFIIIVVAFFWLYNRFQNRPLHEVEYAARRIGKGVIPPPIPESGTAEMRSIIRAFNQMSSDIRSLDNDRTLVMAGVSHDLRTPLTRIRLATEMMSPEDSYLADSINKDIEDCDAIIGQFLDYMRTGKEMSLELCDMNGLLREVICAESNSGKVSEEHLYPYPINITANPIAVKRALTNMIVNATRYGHGWISITSNQNEEYAWFQVEDDGPGIAKEDRQRLFQPFVQGEQARSSTGAGLGLSIIRRIMDAHGGFVELGDSTKGGLLIRANFPLKVQEDEDD

SEQ ID NO: 6800 - protein, 442 aa, Proteus mirabilis
SNIFRRYFVTKTKWTCIRNTQCLPRRILVSFFIDQSIIDNMKRLQAFKFQLRPNGQQEREMRRFAGACRFVFNRALARQNEEHEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYRNSREVVGEVRNVTVSQSCGKWYVSIQTEHEATEPQHGSTSIVGLDAGVTKLATLSDGTVYPPVSSFKVNQRKLARLQRKLSRKIKFSANWQKQKRKIQRLHSHIANIRKDYLHKVTSEISKNHAMIVIEDLKVSNMSKSAKGTTERHGRNVKAKSGLNRSILEQGWYEMRRQLEYKQLWRGGQVLAIPPAYTSQKCACCGHTAKENRQSQSQFECLECGYTANADINGARNILAAGHAVLACGGRVQSDRPSKQEPAEVIQTSV

SEQ ID NO: 6801 - protein, 442 aa, Proteus mirabilis
SNIFRRYFVTKTKLMCIRNTQCLPRQILVSFFIDQGIIGNMKRLQAFKFQLRPNGQQEREMRRFAGACRFVFNRALARQNENYEAGNKYIPYTKMASWLIEWKSDTETQWLKEAPSQPLQQSLKDLERAYKNFFQKRTAFPRFKKRGKNDAFRYPQGVKLDQSNSRISLPKLGWMQYRNSREVVGEVRNVTVSQSCGKWYVSIQTEYEATEAQHESTSIVGLDAGVTKLATLSDGTVYPPVSSFKVNQRKLARLQRKLSRKIKFSANWQKQKHKIQRLHSHIANIRKDSLHKVTSEISKNHAMIVIEDLKVSNMSKSAKGTTERPGRNVKAKSGLNRSILEQGWYEMRRQLEYKQLWRGGQVVAIPPAYTSQKCACCGHTAKENRQSQSQFECLECGYTANADINAARNILAAGHAVLACGGRVQSDRPSKQEPAEVIQTSV

SEQ ID NO: 6802 - protein, 214 aa, Proteus mirabilis
IKIRENNMLNKKIASVMLSTIIAASFATAANADTRVAQATATWQATAIKDTTSMLVVTPLKSLTFNYAEGQKSFNQQNGAFDIAIQGQSGATDFKLSSKLIANTLARTTDDSTLTVGVKWNGEDLSKTTDVVLIDTSKGLTSGLDNLAADGIYNGSERATDRGEFTFVIASAQAAGATADFKSLADGVWDGDVKVQFTATWDGDFSTVKPNPDP

SEQ ID NO: 6803 - protein, 258 aa, Proteus mirabilis
CFYRCFIMFIYSDLKNKNVIVTGANGDIGIAICQKYLEQQCHVYALYHQNRNNLDKLKKESEYCQRLHILQCDINNDKSIHDFLDKLKAYANAIHILINNAGVIKDELFSAINISEFEYVIKTNLLGTCQFTKQLLLLLRSAEKATIINVASIAGIVPSIGQSNYSAAKAGIIGFTHTLAAELAGKGIRVNAVAPGMIESDMVKKVSRQVVRHIKSVIPLQRLGASAEVANTIVFLSSEASSYIVGQTLIVDGGMVMR

SEQ ID NO: 6804 - protein, 143 aa, Proteus mirabilis
TLELKVNGLKLNKFFIFPILLILSLMTTIILLMFPGDREYTKLNFVYYYLYTFDEVKKIDFISDEYIIIYRPIDGNSNEFNDVIFFNIKPEKNIALIDNLSKNGFTSTYDDFYKEERWVKDNIHIKISIDEKSRTTSLFVEKS

SEQ ID NO: 6805 - protein, 104 aa, Proteus mirabilis
QAHRLRLLQKALQCRLFLFSYCGVFMSDDNFSLPTITLDEFQQAPLTALENSSSVEVCDNNQTPLFYCLSKQDYDTLMGRIMDAELAAIVLERRQKKLDELDLE

SEQ ID NO: 6806 - protein, 110 aa, Proteus mirabilis
DINSMENDDKLNEKIEQRKKMLKRVKEGLIERLNLNKSINQIDDDTPLFGSGLKLDSVDATEIIVFLNDEFNIQVTEGDDPSYMRTINSLTTFILNKQREKQEKNESNNN

SEQ ID NO: 6807 - protein, 295 aa, Proteus mirabilis
PTNSQHQKINKILINNKIRGFIMKLHFLGTAASEGIPNPFCRCEHCLKARKLAGKDIRTHSSAIVDDIILIDVSPTFSYQLMRDGMDATHFESLLFTHTHPDHFNVGELFSRMEGYGFEINHPLHIFGNDRAINGCIEVLPGYTKERFAFHCLIPFVTVERNGYKITPLLANHAKWELCYVYHIEKDGKAIFYGHDSGWFPELTWQWLENKPLDIVVFECTYGLNGKDRTDNHMSLETVFAAKEKLQQQGCLHQATQIVVSHISHSGKLLHHELETVCAPHHIRVAYDGLTLETN

SEQ ID NO: 6808 - protein, 307 aa, Proteus mirabilis
LSDRYHSDESRSSSKAVTMWRLFWQRLAQDKSAQLCLLVIVMITIAGIGAPWFAPHDPTLTSIRLKFQPISFHYPLGTDNLGRCVFSRLLFGIRTTVFYAIYAMGITLLIGWLMGMLAGYFHGKTDTVIMRLCDVVLSFPAEIMILALVGIMGPGIGNILIAVILVKWAWYARMIRGIVRQYSHRHYIAYAQVIGAPPTHILRRHLLPVTLAETIVLASSDIGSVILMISALSFLGLGVQPPTPEWGNMLSEAKNVMVLHPEQMLPAGIAITVVVTAFNFWGDFLRDVFDPDNRQSVGDKYEQFTDA

SEQ ID NO: 6809 - protein, 714 aa, Proteus mirabilis
NRGRSALYLFESLNQIVQKYLPPEQVEQLKKAFIVARDAHEGQTRSSGEPYITHPVAVACILADMRLDHQTLMAALLHDVIEDTPATFKDIETLFGSTVADLVEGVSKLDKLKFRDKKEAQAENFRKMIMAMVKDIRVILIKLADRTHNMRTLGSLRPDKRRRIARETLEIYSPLAHRLGIHHIKTELEELGFEALHPNRYRVIKEVVKAARGNRKEMINKILSEIEGRLTEASIQCKVNGREKHLYSIYRKMLLKEQRFHSIMDIYAFRVIVKDVDTCYRVLGQMHSLYKPRPGRVKDYIAIPKANGYQSLHTSLIGPHGVPVEVQIRTEDMDQMAEMGVAAHWAYKEQGEQPGTTAQVRAQRWMQSLLELQQSAGSSFEFIENVKSDLFPDEIYVFTPEGRIVELPTGATPVDFAYAVHTDIGHACVGARVDRQPYPLSQSLRTGQTVEIITAPGARPNAAWLNFVVSSRARSKIRQLLKNLKREDSINLGRRLLNHALGHHKVADIPLENIERELKRMKLHSMDDIMAEIGLGNAMSVVVARNLLIDNQQQEEHTHLSITNDETPKLPIKGADGVLISFAKCCRPIPGDPIVAHISPGKGLVIHHESCRNIRGYQKEPEKFMPVEWDKDIDGDFITEIKVDMINHQGALANLTAAINDANSSIQSMNTEEKDGRVYCAFIRLTAKDRIQLANIMRKLRIMPDVLRVSRNKN

SEQ ID NO: 6810 - protein, 85 aa, Proteus mirabilis
LKVRLFNGVTTNILVVSLIAVACQVAVACATRVSALAAVAKEAAIIVDSITDAIFLFNILFSLILIYKKQLHSIKNTFNCAFYKI

SEQ ID NO: 6811 - protein, 257 aa, Proteus mirabilis
KGDRMAHLLIVNADDFGLSRGQNYGIVECHRHGIVTSTTALVNAEGIEHAAQLCKELPHLGVGLHFTLTMGQPLSPIPSLTRNGVLGKWLWQMAEQEQLPLDEIRVELNAQYQRFVELFGCPPDHIDSHHHVHMFKQIFPIVAEFAQQKALPIRVDRLLAQKESLNTQGVISSDGFDSQFYGDEISQALFLKTLDDAKARGEQSLEVMTHPAFIDNPLRASGYCFQRLTELEVLTQSSLKQAIAERGYQLGTYQDLI

SEQ ID NO: 6812 - protein, 265 aa, Proteus mirabilis
YNSRFLMTNKIDNNQLLHDVTRYWNIRAESYSAANQQELLSEKQQKWRQLLLSHVKEGETLKVLDIGTGPGFFAILLALSGHQVTAIDATPGMLLEAKNNASQHNVSINFVCGDVQDLPFGDEQFDLVVSRNVTWNLKSPCEAYQEWFRVLKPGGSLINFDANWYLHLFDDEYWQGFLADRERAAQKQVADHYVNTDTKEMERIARQLPLSQVKRPQWDINTLLDIGFIRYSVDIRIGDHVWDEEEKINYGSTPMFMIHAQKNNR

SEQ ID NO: 6813 - protein, 87 aa, Proteus mirabilis
LSLSHKRKNKMASLMQVRDCVALNGRADARLVSHQLNMPEPMVKAMLERLTLMGKLQEVDVEECLVGSCKSCPEATACQTKVYQLRS

SEQ ID NO: 6814 - protein, 60 aa, Proteus mirabilis
IQPSFIELPPLYRLFKYPRRNEMTGEVNEKYLRAQSASDGEGGKRSEPTKLTGRRGGMPM

SEQ ID NO: 6815 - protein, 359 aa, Proteus mirabilis
MSKSYSTYPTGGIMKLMRTTLTSVIAAALSMTALSAQATTSLTGAGATFPAPVYAKWADSYQKETGNKVNYQGIGSSGGVKQIIANTVDFGASDAPLADEKLKADGLFQFPTVIGGVVMAVNISGIKSGELVLDGETIGNIYLGKIQKWNDPAIAKLNPKLNLPDQNIAVVRRADGSGTSFVFTSYLSKVNSAWKDEVGAGSTVKWPTGLGGKGNDGIAAFVQRLPGSIGYVEYAYAKQNNLAYTQLVTADGEVIPPTADSFSAAARKIDWSKSFAQDLTNQKGENAWPITSTTFILVHQTQKDAAKGKEVLNFFNWAYEKGNDEAKNLDYAVLPKEVVEQIRAAWKTSIKDSNGKPIY

SEQ ID NO: 6816 - protein, 281 aa, Proteus mirabilis
RMLSYRHSFHAGNHADVLKHIVQTLIIESLKEKEKPFLYLDTHAGAGRYQLTNAHATRTGEYLEGIARLWQQEEVPELILPYLEAVGSLNTSDELRYYPGSPLLAAKLLREQDLLMLTELHPTDFPLLRTEFSRDKRVRVCREDGFGQLKSKLPPASRRGFALIDPPYELKQDYSAVVKGIVEGYKRFATGTYAIWYPVVHRQQIKRMLKELEATGIRKILQIELAVKPDSDQLGMTASGMIVINPPWKLASQMASILPWLHKTLVPEGTGHTLVEWVVPE

SEQ ID NO: 6817 - protein, 534 aa, Proteus mirabilis
QMMRVRMEQQYFIGVDVGSASVRAAVFDSFGKRLGFSVRPIAQFRPKTDFVEQSSADIWQQVCTTVKESVKLSAIDPLHVKSIGFDATCSLVAVGKEGQALSVSPSNKPEQDIIMWMDHRAVQETVTINLTNDPVLRYVGGEVSIEMELPKILWLKNHYPERYKHVWRFFDLADFLVWKATTADVASICTLTCKWNYLAHQGHFSESLLADVGLDELLEKVPQTILALGESAGCLTTSVAEAFGLHTGVIVASGIIDAHAGGLALTASQPEGSLAIISGTSNCHMIVSQYPIMVPGVWGPYFGAMLPELWLNEGGQSAAGALVEWSIRRHESWADLEQEAKEKGVSYYTLLNQAVAELEENEPYPTAQFHVLADHHGNRSPRANPAAKGMVSGLTLESGRVALARYYLATLQSIAYGTRHIIDTLEDAGHQINRLVMCGGATKNPLWLREYANATGREIHLAQEEDAVNLGAALLGAVACKAFDNFSQAANTMVREGGVITPDSDTFAFHQAKYQVYLQMYQDQQRYNDMMADC

SEQ ID NO: 6818 - protein, 192 aa, Proteus mirabilis
LQMSFSMIHIITLSNPQLADMFVNYMATKGVRIHAKTENQQVSLWLENEQQLNQVESELKTFLREPFHPRYQAASWQTGTPQRTGLQYRPAFSIKSMVQQSGPLTVLTIILCVLVFIWQQIVGDYNVMLHLAWPYDASLDFELWRYITPAFVHFSLMHIAFNLAMWWYLAQPNRKTTGYRQIICHYAHFCAI

SEQ ID NO: 6819 - protein, 94 aa, Proteus mirabilis
TFVSFTNFMVYTGIKQNTFTCSGFTGVDVRTNTDITIACYGGLTSHFFLSRGRSIQVKDSIAVLKRVATTSRITSGSVRTPCLHLPYGERLHVS

SEQ ID NO: 6820 - protein, 711 aa, Proteus mirabilis
TPTREEKMARQTPIARYRNIGISAHIDAGKTTTSERILFYTGVNHKIGETHEGSATMDWMEQEQERGITITSAATTAFWSGMAKQFEPHRVNIIDTPGHVDFTIEVERSMRVLDGAVMVYCAVGGVQPQSETVWRQANKYHVPRIAFVNKMDRMGANFLRVVEQIKTRLAANPVPLQIPVGAEEDFTGVVDLIKMKAIRWNEEDQGVTFEYEDIPADLQDLAEEWHNNLIESAAEASEDLMDKYLGGEELSEAEIKSALRKRVLDNEIILVTCGSAFKNKGVQAMLDAVIEYLPAPTDVPAIKGILPDGKDTPAERHSSDEEPFSALAFKIATDPFVGNLTFFRVYSGVVNSGDTVLNPVKDKKERFGRIVQMHANKREEIKEVRAGDIAAAIGLKDVTTGDTLCAIDAPIILERMEFPEPVISVAIEPKTKADQEKMGIALNRLAQEDPSFRVSSDEESGQTIIAGMGELHLDVLVDRMRREFKVEANVGKPQVAYRETIREEITDVEGKHAKQSGGRGQYGHVVIDLSPLPSGGEENYVFVNDIVGGVIPKEFIPAVDKGIQEQLKSGPLAGYPVVDIKARLHFGSYHDVDSSEIAFKIAASMAFKEGFMKAKPILLEPIMKVEIETPEDYMGDVIGDLNRRRGMVEGMDDLPTGKIIRAQVPLAEMFGYATDLRSQTQGRASYSMEFLKYNEAPSNVAQAIIEARKAK

SEQ ID NO: 6821 - protein, 216 aa, Proteus mirabilis
SKTSFLLWREFMLYIFDMGNVIIDIDFNRVFAVWSKLSGVPLASIKDNFTTGETFKLHERGNITDIEFAEAVCAELGIGLSFEQFAEGWQAIFIAVRPEVIDIMNKLREQGHRVVVLSNTNRLHQDYWPQHYPEIAASADFLYLSQDIGMRKPDPEVYKYVLQSEGVEAQDAVFFDDLQTNVDAAIALGIQGVHVVDKNTVVEYFKDHDFTLPVTE

SEQ ID NO: 6822 - protein, 331 aa, Proteus mirabilis
RSKSMALLNINQLSVHFGDEDTPFKAVDRISYQVEEGQVVGIVGESGSGKSVSSLAIMGLIDFPGRVSAEALQFDGRDLMQISESERRDLVGAEVAMIFQDPMTSLNPCFTVGYQIMEALKVHQGGSHRTRKQRAIDLLTLVGIPDPASRLNVYPHQLSGGMSQRVMIAMAIACQPKLLIADEPTTALDVTIQAQIIELLLELQKQENMALVLITHDLALVAEAADTIIVMYAGQVVESGLATEIFKAPRHPYTQALLKALPEFASDKARLESLPGVVPGRYDRPMGCLLNPRCPYAQDTCFQIEPELKEIGKHRVKCHTPLDDTGRPTYG

SEQ ID NO: 6823 - protein, 508 aa, Proteus mirabilis
RSLGMEILDALMVVFSLETITMILLGVFAGIIIGALPGLTVNMGIALLLPLTYSFQGMTGILLLLGMYCGAVYGGSITAILISTPGTPASAATVLDGYPMAKKGEAGRALGLSTMGSMFGGVFSTIALIVIAPQLAKVATGFSAAEYFALAVFGISIITSVSSQSIVKGLMGGAIGLAIATIGLDPMTAGPRFTFDTVYLMGGVSFIPILVGLFAFSQGLISFEEEYRERKQKKSEKINARIHRVLPTWLDFKRVLPTYFRSSAIGTAIGAIPGTGGDISSFISYNEAKRWSKHPEEFGKGSPEGVSAPEAGANSVTGGTMVPLMTLGIPGDGATAIIMGAFMVQGLALGPQLFTDNPVEVNSIFIGLMMANIFLGILGFLCMKLFVRVMDVPRRVLVPIIFVLCSVGAYSVNHSIIDVFVMMGAGLLAYIMIKLDFSMSPVVIGIILGPMAESNLRRALMMSQGDLSILYTRPITATFLAIALLTLLLPIVGPGLKSMWKKWRSQSA

SEQ ID NO: 6824 - protein, 487 aa, Proteus mirabilis
AFIGYTIISGGHNVCWLVWHIGGSLLEGRSMSEQTIIWDLDLIHKYNYSGPRYTSYPTALEFNQQYSDADFEQATKRYPERPLSLYIHIPFCHKLCYFCGCNKIITRHKHKADEYLDVLEKEIINRARYFKNRKVTQMHWGGGTPTFLDKQQISRLVALLRQHFHFVENAELSIEIDPREIELDVIDHLHNEGFNRLSMGVQDFNKEVQQKVNREQDEAFIFSLVARAREVGFHSTSIDLIYGLPKQTKESFAFTLKKVIELSPDRLSVFNYAHLPNLFAAQRKIKDEDLPLAEEKLEILQETITTLTTNGYQFIGMDHFAKPDDELAVAQRQGILHRNFQGYTTHEECDLLGMGVSAISMLGDHYAQNEKVLKEYYARVNSEGHALWRGLSLTHDDCIRRDVIKTLICNFHLNFTEIENLYQLDFQDYFKEDLALLAPMVEDGLVEISAEKIQVTPRGRLLIRNICMCFDTYLRNQMRQRQFSRVI

SEQ ID NO: 6825 - protein, 572 aa, Proteus mirabilis
RHDGRLLTINFSDYESSLPYQGYLMLNLNLPKLPDVISAEANEILMVTNADLREPANVTCWPVQKKFEDKLAAALKAQGYTMKRAHKIDEARGHGFISSQREGCDMFAAIDPDAPVIVLLTAWQYSHHIASSLAHHRGPILLLANFDGTWPGLVGMLCLAGTLTSLGKNYSRLWSENFDDTFFIDGLATWLKYGYVNHQLSYLKEVAPTHRVMATEAGEVGRKVGEYIIKNKEIIGLFDTFCMGMINGVFPQQAMIDIGMPIESLSQSALLVEMAKVPDALREECVQWYENNGMTFKFGTDDKTELTREQVKEQCAMMIAMARFVKRFGLTAVGVQYQQGLKDCCPASDFAEGAIGSTARFPLPDENGDIISPNTPIPCINEVDMGTAIPQTMLWRLLTSLGLPAETTLHDIRWGSEYQGTFYWDMEISGSVPFEHLKGGIKGATGYRQPAMFFPKGGSTIAGQGKAGRLLWARAHYQGTDVIMHIGTGMAVELPEAEFERRRRATNYEWPLLNCTLDGVTRDDLMAGHQSNHITVAYVDDDKLAFVLQAFVAQALTQGIQVKVAGDAINLL

SEQ ID NO: 6826 - protein, 163 aa, Proteus mirabilis
ILNGVFPCPRRRVIGQRKILPDPKFGSELLAKFVNILMVDGKKSTAESIVYNALETLAQRSGKTELEAFEIALDNVRPTVEVKSRRVGGSTYQVPVEVRPVRRNALAMRWIVEAARKRGDKSMALRLANELSDAAENKGAAVKKREDVHRMADANKAFAHYRW

SEQ ID NO: 6827 - protein, 359 aa, Proteus mirabilis
INLGHRSRNMPFVMKETQFVLDNAHSLFNHCHASTIVRVPNSERLLTAFFAGDKEGSGNTAIWLAIKEGNDWQPAQPVVKNPGVAHWNPVLHVDPSTGNIWLFYKTGPDVHSWTTQYVISKDGGNSWSLPSELVSGDVTPRGPVKNKVLVMSNGEWLAPGSVEDDRYWDAFVDISSDNGQHWQRVDIPIAHHQGGQAEHEIWQGLKDDALWETDLQRVFQWDGVIQPTLWGSQPGHVHAMMRSTRGKIYRSDSTDYGRSWCPAYATTLPNNNSGIDVVSFADGLLALVYNPNSGNWSRRYPISVSLSSDNGSTWSEPFDLLDGEGEFSYPAIIAENNTLHVTFTWNRKNIVYQQLIATQ

SEQ ID NO: 6828 - protein, 185 aa, Proteus mirabilis
AKLGIKMAKLTLQEQMLKAGLVTNKKMAKVQRTAKKSRVQAREAKEAVEEKKRLQLERDKQLSEQQKQATLLKEYKAQVKQLIEMNRITPAKGDIDFKFTDNNVIKTLEVDKVTQSQLINGRLAIARLVIDSAGNNEYAIIPASVADKIMQRDADCILLNNTLSQAEQDEDDPYADFKVPDDLMW

SEQ ID NO: 6829 - protein, 138 aa, Proteus mirabilis
ITVGGVMQNETDPENLTLLDESTSTSLVPYRGIRLANNPINKLMRKIKQKLATLNEINIVTLVSWIATVTACGMYVSYIPQIMDNLNGIKTSPFQPFVAAINCLLWTYYGVKSKEYPVAIANAPGILFGTIACLTAII

SEQ ID NO: 6830 - protein, 73 aa, Proteus mirabilis
FVAGMAARLFADKAPDATGFVVGFATGLVCVVAGGVTGLVGVGLTSGFCVGAGCGLVTGVCGVVGWFCVFCCC

SEQ ID NO: 6831 - protein, 75 aa, Proteus mirabilis
KNKGRYITRKDSTPHYLFAFILIFLLFNRLFIYSELRIMRHGRKWTINQGWLVLCDISFPPLMFHSQISSLTLFI

SEQ ID NO: 6832 - protein, 141 aa, Proteus mirabilis
GEKGMSQPSQESAVRLDKWLWAARFYKTRAIARTMIEGGKVHYNGVRGKPSKNVEVGAEIRLRQGNDERTVTVLMVSAQRLGAAQAQLLYCETPESIAKREKIALARKMNALTMPHPERRPDKKERRTLLRLKQTNLPGSD

SEQ ID NO: 6833 - protein, 84 aa, Proteus mirabilis
LVEGRFMSLIPNHSYKILSYSPQISPAYRQKLLSLGMLPGAIFNVIRIAPLGDPIQIETHRVSLILRKKDLALINLSEIAHNEK

SEQ ID NO: 6834 - protein, 124 aa, Proteus mirabilis
NNMGIGTDIIEIKKVAIAICRSGEPLTQRLLTEYERNSIGRIHENYHRVAGFWAAKEAAVKAIGTGFRLGILFHDIEIRHDEYGAPCYFFTGHFSNLLKQKKITQSLLSISHCDHYAVAVAIFN

SEQ ID NO: 6835 - protein, 313 aa, Proteus mirabilis
DLTGQNMKYHSLLKNLFYATLSIMALNFSGVTMAKNTMNDIYVINLSSNKAVCGIKINELLVSDNTMAVEGSYSTGQNISSILANGKNTLGIIMFNGSVFTGEEKLTPDMWCEVELKKLSANGDNTLISGLRLNGNNDGKMVVSDKYQNNSEHIYFGSPSRKSEFDALEAKNQFNIQGLPQWQWEKATPVTEDDIPKIRAFYTELRQAFIDKNLDKLKTMGKISWEEMAYADNGSPDIFWNSLEFKELLKDGYKPSDIDWNRYELNTYNNNRLFRYEIGFSRLSPIKLVNPEERTFHYNPYLSIIDGKVTIVR

SEQ ID NO: 6836 - protein, 345 aa, Proteus mirabilis
QNEGNINDGTLMAKTVEQIANDLNLSITTVRLVLNGKGDQYRISAKTQKKIADYVEVFGYTVNHAARSLKLNKTDTYGLVIPRLSNPFFAALAEKLEMHCHQIGCQLMISCTYGDIKNENKLVKSMDERNVDGIFIVSASRKNQQHHVKHRQKPLVFLDRDFSVSNAICVASDNCDSGAQLTKAMIQQDAPIHFFAGDALLPTIAARLRGYVQAIKAHYGDESHVTVSYAEHNTTKDGEQMMKQYLEQHRQIPSHFIASSLPILEGVLSAIRQTEGVIPAHINIGTFDDHVMLSFLPNNVWSMKQDETLLVEKAFEIMTAKIAGNVVKAPPLIKTQLIKRLIAGA

SEQ ID NO: 6837 - protein, 79 aa, Proteus mirabilis
WDFIVDVVAVFVISVSAGLAENVGDRGDVTATCSTLKVFTIISNIEACSLSVAEAAVDCSTIAAFCCVALSISLTARLI

SEQ ID NO: 6838 - protein, 111 aa, Proteus mirabilis
EGFMQKKYIYLFCSAGMSTSLLVTKMRAQAEKYDVPVIIEAFPETLAEQKGQEADVVLLGPQIGWMLADIQKLLPNKPVEVIDSLLYGKVDGLGVLKAAVAAIKKASATTN

SEQ ID NO: 6839 - protein, 322 aa, Proteus mirabilis
RGFMAEHTTVIKAPSKRGDVIFSALVRLAALITLLLLAGIIVSLIFASWPSIQQFGLSFLWTKEWDPPAQEFGALVPIYGTVVTSIIALIIAVPVSFGIALFLTELAPNWLKRPLGIAIELLAAIPSIVYGMWGLFIFAPLFATYFQEPVGNVLSSVPIVGELFSGPAFGIGILAAGVILAIMIIPYIASVMRDVFEQTPVMMKESAYGIGCTTWEVIWNIVLPYTRNGVIGGVMLGLGRALGETMAVTFIIGNTYQLDSASLFMPGNSITSALANEFAEAETGLHTAALMELGLILFVITFIVLAISKFMTLRLSKNEGAR

SEQ ID NO: 6840 - protein, 646 aa, Proteus mirabilis
TTFMIVFSSLQIRRGVRVLLDNASATINPGQKIGLVGKNGCGKTTLLSLLKGDLQAEAGNVTFPSTWSMAWVNQETPALDVPAIDYVIDGDREYRELERRLQQANDNNDGHAIALIHGQLDAINAWTIQSRAATLLNGLGFSQQQLTEPVKSFSGGWRMRLNLAQALICRSDLLLLDEPTNHLDLDAVIWLEKWLKSYNGTLILISHDRDFLDPIVDKILHIEQEKIFEYSGNYSSFEMQRATKLAQQQALFENQQAKIAHLQSFIDRFKAKATKAKQAQSRVKMLERMERVAPAHSDNPFQFSFRQPESLPNPLLSMEKVSAGYGDKIILNNIKLNLIPGSRIGLLGRNGAGKSTLIKLLAGELAPLQGKVALSKGIKLGYFAQHQLEYLRADESALQHLTRLAPQETEQKLRDYLGGFGFHGDKVTDACGQFSGGEKARLVLSLLVWQRPNLLLMDEPTNHLDLDMRQALTQALISFEGAIVVVSHDRHLLRSTTDDLYLVHDGQVEPFEGDLDDYQQWLVDQNRQETQANKTQPDQETTNASNLTAQDKKEQKRKEAEFRQQTQPLRKKLTTLESKMDKLSQELTAIETELSDSQIYEAKNKATLTDCLSRQSIAKSALEEVEMAWMELQEKLEEMTNAFESQ

SEQ ID NO: 6841 - protein, 123 aa, Proteus mirabilis
YFFLYNISAHSLINIKTNKNKKINMLNKNDRDKLIKNNKYKNIKFNVKCNIQVILFISLISLVFINNENLPLKYKIALSGGMISFIYIFSAYHSFGSLYLANKITYVFIKIKIKKLITYIFRK

SEQ ID NO: 6842 - protein, 693 aa, Proteus mirabilis
EAIMTTETFLVEIGTEELPPKALRSLAESFATHFTAELDNANITHGDVSWFAAPRRLAIKVANMAKSQADRIVEKRGPAIAQAFDAEGKPTKAAEGWARGNGITVDQAERLSTDKGEWLFYRAEVKGEAVNQLLAGMVSNALAKLPIPKLMRWGDKETHFVRPVHTVTLLLGDTLIDGEILGVQSDRIIRGHRFMGEAEFTIDNADQYPEILYERGKVIADYENRKSIILHDARLAAEKLGGVADLSDSLVEEVTSLVEWPVVLTAKFEEKFLEVPAEALVYTMKGDQKYFPVYDKQGALLPHFIFVSNIESSDPQQIISGNEKVVRPRLADAEFFFKTDRKQRLEDNLPRLETVLFQKDLGSLRDKTDRIQALAGFIAEKMGADVNKATRAGLLSKCDLMTNMVFEFTDTQGVMGMHYARHDGEDEEVAVALKEQYQPRFAGDALPSNPVASAVAIAEKMDTLAGIFGIGQHPKGDKDPFALRRAALGVLRIIVEQDLPLDIEELTQEAARLYGDKLTNKNVVSDVVEFMLGRFRAWYQELGYSIDTIQAVLARRPTQPADFNARVKAVTYFRTLEEAAALAEANKRVSNILAKSADVKLNDKVLASVLKAPEEVQLAANLSVLQDKLAPLFAERKYQEALVELASLRDVVNNFFDKVMVMDKDEEIRINRLTMLHELRELFLKVADISVLQ

SEQ ID NO: 6843 - protein, 242 aa, Proteus mirabilis
KLIMNPTRYARICQMMAMRQPDLTVCLEEVHKSHNVAAVIRTADAVGIPKIHAIWPEEKMRMLVSPAAGSNSWVNVNTHPTIADAINTFRAQGMQVLATHLSDKAVDFREIDYTQPTCIIMGQEKTGISPEAIALADQDIIVPMMGMVQSLNVSVASALILYEAQRQRQAAGMYNRTESALTAEEQQILLFEGGYPVLAEVSRRKGLPRPYINDRGEIEAPDSWWAEMQMTQKQLRKFKLTE

SEQ ID NO: 6844 - protein, 248 aa, Proteus mirabilis
VIIMFAQFLSHYLLEPHYLSWLWQGFLITLLISFWTIIIATLLGFLLSAAYDSHIAPLRWCAAIYTSLFRNTPLLVQLFFWYFASGELLPQTAMIWLNTPHELSLFGLTLSWPSFEFLAGIIGLTFYSVPFIAQELRAGIQGVRQGQKYAALALGLTHWQSMRYVILPQAFRIALPPLLGQYMNIIKNSSLTMAIGVAELSYASRQVETESLRTFEAFGVATILYIAAIALMEAWGQWHQQRKLAQGY

SEQ ID NO: 6845 - protein, 475 aa, Proteus mirabilis
GGIMSLKTSSLPFKTLIDRQVHDQIMQKAVANAQETIGRNRQKMVDELGHWEDWRDRAAQIRDHVLANLDAYLYQLSEKIEQHGGHVFFAQTKEEASQYILNIAKEKKAKKIVKAKSMVTEEIGLNPVLENAGINVIETDLAEFILQQAKDAPSHVVVPAIHKNRAQIRQIFHDKLGYNGSDTPEEMTRFVRQNIRDDFFTADIGITGCNFAVAETGSVCLVTNEGNARLSTTLPKTHIAVMGMERIAPTFKEVDILITMLARSAVGLRLTGYNTWLTGPKENDNVDGPEDFHLVIVDNGRSKIIGSEFKDILRCIRCGACMNTCPAYRHIGGQGYDSIYPGPVGAVLTPLLGGYKDFKNLPYVCSLCTACDSVCPVKIPLSNLIKKHREVMVEQGITPTTERNITRVFNYVNRHPMLWKVGMNMGAHATKWFIKEGKAPLKIGAIKAWTEARNLPEGDGESFRSWFKKHQKEEK

SEQ ID NO: 6846 - protein, 297 aa, Proteus mirabilis
EKIMSKKDALSRFLFEKSAVRGELVTVTETYQSILENHHYPEPVQHLLGDLLVATSLLTATLKFDGDITVQLQGDGPVRLVVINGNNEQQMRGVARFSDDVKAGSSLKEMMGNGFMVITITPKKGERYQGIVALDGETIEACIDNYFNQSEQLPTRVFIRTGLQDGKAAGAGMLLQALPASAEHSADETAEHFELLTQLTHTIKAQELFTLDTKEILHRLYHEEDVTLYDPQPIAFHCTCSRKRCEDTLVTLSKEDVAHLLQEQGKIDMECEYCGAHYIFTEEDINNINKLSSSNLH

SEQ ID NO: 6847 - protein, 500 aa, Proteus mirabilis
EDVMETKDLIVIGGGINGAGIAADAAGRGLSVLMLEAQDLASATSSASSKLIHGGLRYLEHYEFRLVSEALAEREVLLRLAPHIAFPMRFRLPHQPHLRPAWMIRIGLFLYDHLGKRVSLPGSKSIKFGANSVLKPELTRGFEYSDCWVDDARLVVLNAQEIVRRGGEVRTRTKVTRAWRENDLWMVEAQDLRTGETSRYQAKALVNAAGPWVKTLFDEGLKLKSPYGIRLIKGSHIVIPRAHDEPQAYILQNEDNRIVFVIPWMDEFSIIGTTDVEYKGDPKDVAIDNNEVEYLLKVYNDHFKKQLTKDDIVWNYSGVRPLCDDESDSPQAITRDYTLDLHDDNGKTPLLSVFGGKLTTYRKLGEHAVDKLNAYFPNMGQAWTKEGQLPGGNLEGYDRDGYSRLIRQRHPWLPEALALRFARTYGSNTEVLLEGITDLAGMGENFGHNLYEAELRYLVKHEWVIELDDAIWRRTKLGMWLNDEQKQRITQWLEANTHTA

SEQ ID NO: 6848 - protein, 134 aa, Proteus mirabilis
FDVIIVISFSRSEHNNVINNIINKTIMDSFQFLSIEQAYQFWVSQSAILVDVRDPQSYRLGHATGAFHLTNDTLNQFLQDADFDVPVMVMCYHGHSSQGAAQYLVNMGFETVYSINGGFEAWLREFPQAITSLQ

SEQ ID NO: 6849 - protein, 307 aa, Proteus mirabilis
ELTMYHLRTPKTQAELAAYYTFRWEMLRKPLHQPEGSEKDGYDTLAHHQMVVDDSGQPVAIGRLYINADNEGAIRFMAVREDAQGKGLGSLVAMALESLARQEGVKRIVCSAREESVRFFEKLGYENCGLVTGPQTTPIKHYFMKKSIESLDDILHRPDWCAELQKQWHQHIPLSEKMGLRITQYTGTRFYTTIPESGNQNPHHTIFAGSQFSLATLTGWGLIWLLMQEHKLQGDIVLVDAHIRYRKPVSGRPSAVADMENLSGDLGRLAKGSKARIKLDVDICGDEGTGAVFSGTYIVLPSQNKQY

SEQ ID NO: 6850 - protein, 310 aa, Proteus mirabilis
VGTITSHLTIRYSPYFEKEHDMSIKHPIIAVTGSSGAGTTTTSQAFRKIFQQLNAHAASIEGDSFHRYTRPEMDMAIRKAKEQGRHISYFGPEANDFNLLSSTLSHYSQTGQGQFRKYLHSYDEATPYNQLPGTFTPWEALPEKTDILFYEGLHGGVVTDQHNVAQHVDLLVGVVPIVNLEWIQKLIRDTTERGHSQEAVRDSVVRSMDDYISYIIPQFSRTHINFQRVPTVDTSNPFSAKAIPTLDESFIVIRFRGLTDIDFPYLLAMLHGSFMSTINTIVVPGGKLGLAMELIMAPLVKKLLNGEKIS

SEQ ID NO: 6851 - protein, 124 aa, Proteus mirabilis
MATINQLVRKSRSSKVVKSNVPALEACPQKRGVCTRVYTTTPKKPNSALRKVCRVRLTNGFEVSSYIGGEGHNLQEHSVILIRGGRVKDLPGVRYHTVRGALDCSGVKDRKQGRSKYGVKKPKA

SEQ ID NO: 6852 - protein, 231 aa, Proteus mirabilis
KLTIMNKIKLILFLLLWFPLKNSFAVNVGNITEIISSDESTLAKEIENTVNTARLVNLTIEKLDSPLENGKVIPVTDPNEILSTPANLILPGHASDVFKIIYQGPKDDKERYYRLNWKDDPIAENGITQSSKSATATTSATISTILVVAPRIENFNYQYHDNKVSNIGNSSFRVVASGPCLAEKQQYGVEGMCRERYYLMPHLAVKLQLVDLTNKKSSVGIWHKGEFIVVK

SEQ ID NO: 6853 - protein, 343 aa, Proteus mirabilis
LSYIGAIMLPNYHYYMQAHHHTMLTPIYIASIVLSLCFINNYNELSFWLLFMGNFAIFIVILLSAMMNERIYWRYCIFSEKFYLKNNNKSDIKRTIISRYFTVFSLSYIIGVIIIFLVTSYLIEIVFDSQIYIIIFLGFFLSPLMIWFFMYFLIKFYVSCSIHYLNNFSLYSREKKKFNISYIIVNEVFLSLLVNFPIVFPLQNSATFSLEQGYLNIEFIVALIILLYSVLFVMLFLSKASKINYLMGMIICYSFEEDFAEVKKRGLFCRVLWFLILIPLGTLLLCLLFYLLNIKENFFLIYSVSLSLVIYLYFIERRNKLYQEFILAFDMILRLKALKNFKE

SEQ ID NO: 6854 - protein, 343 aa, Proteus mirabilis
RGYMSEETQKKASNKNTQLTQPIKHGLEKGLHGGKKAIGIGIKFTNFVTNIPFIAHLIRAAERFTDRMGNQFGAAITYFSFLSLIPVLMLSFACAGFILASNPDLLAKLITGVANSIDDPTLASTVQQSIDTAVRQRTTVGLTGLAIALYSGVNWVGNLRQAILAQSRPIWERNKEDQEKIYFRYFRDFLALIGLLVALVITITLTSVAGSAQKLIVHTLGLDGIEWLTPAWTTIGLTISISANYLLFLWILWILPRHQPKRISLLKGTLIAAIGFEILKSVMTWLLPRLASSPSGAAFGSVIGLMAFFYFFARLTLFCAAWIATDGPNMRKEKHKSETQSIT

SEQ ID NO: 6855 - protein, 303 aa, Proteus mirabilis
LRYIPQFTEGSMDTNLSTRLNKYISESGICSRREADRYIEQGLVLINGKRAGIGDRVTAGDEVKVNGRLIEAQDNSELVLIALNKPVGIVSTTDEGEKDNIVDYVNHSTRIFPIGRLDKDSQGLIFLTNHGDLVNKILRAGNSHEKEYLVTVDKPITDEFIRGMGAGVPILGQKTKKCKVKKEAAMVFRITLVQGLNRQIRRMCEYFGYEVTKLERIRIMNVSLAGLPVGEWRDLTDDELIKLFDAIEASSSEAPKQKQNKPKKQISSNAKALGIHIPKTKAKETENNTRKRFAQPGRKKKKR

SEQ ID NO: 6856 - protein, 228 aa, Proteus mirabilis
NFNMKLISWFKILCGMLLVFFYHHAYALYISADISSMESGEPFFSKPYINDTKKTNLYTFSAYQIDRPGYQEQGTPIQNGEILFTPLKKILLPGEQEFFKIFYRGEADEKERYYKIIISETPLDIRNDEGQKKQPLFYPTVSLETYFVVRPKDPDFKYDLNINQGILKNTGNTYFRVLLHQNCDGDDDSEPYVFYLLPNQQIKDLRISQKSRKYIVIFDKYYSIGNCE

SEQ ID NO: 6857 - protein, 521 aa, Proteus mirabilis
GKNMAKKKFSESIQRFGRTLLLPIGVLAPIGMILGISGALVQSYMIARFPFLGNETVNALLVSIRSIAGVVFDNIPLLFAMGVAYGMSHKDKGIAVFASVVGYLTLISTINIWLVLTGKLADPAVMTQVGQIKVLGIQTMNISAAGGIITGLIAAWATDKFYNLELPTAFAFFSGKKSVAIIMVGLMIGVGALLPFIWEVLVMGLTKLSAVFLSPVGPFFTAGGERLFIPFGLHHVWNVLFRFTEAGGSYVIDGQTYVGVVPAMTEVLFNQGPSSEYWSMMPSLTRFMAQQQMLVTLFLFPAIALAIYRTSKKENRAEVKSMLVTMVLTAMLGNVTEPLEFTFVFIAPLLYLIYAIIVGIGAVLLSFAGVAIGYIRGTVFDFTIFGLLYEHTNWIYLVIIGLGLAVVTYFIFYWAIIKFDIKTPGREESSNMKNTLIKEKRYGEIAEILIRALGGKQNIRNVDNCITRLRVDIGEVNQIDKELMLESGCTAFFIPAANHVHIVYGPKVEFVRNAVDEAMKK

SEQ ID NO: 6858 - protein, 310 aa, Proteus mirabilis
VMNIKYRADIDGLRAIAVILVIFFHLDNRLIPSGFIGVDIFFVISGFLISLIIKTSLLQGHFSFGDFYIRRLWRLQPLYLFVLVAVLVISGIFYLPSDYLDITNSEKYASAFLSNKYFARATTSYAAQDALFLPLLHTWSLAIEWQWYLFLPFVLYFLHKINHKEKINNFYFIVFITIISFSLVLVYQKDQPKNYYYFSTRIFEFMLGACVAYLPVKVIINQRVNSVISLIALGVIFWIAVQKDVIAGYPNFNTLYVCLSVALIIYTGQHGSIIQKVLSLKPIVIIGLLSYSLYLWHWPLICYCALYRRI

SEQ ID NO: 6859 - protein, 249 aa, Proteus mirabilis
YVNICLLCEEGADNSALSALAQRWGLIHDATQTMALVLTPTHLELRKQDEPKLGGIYVDFVAGTMAHRRKFGGGRGEAVAKAVGIKKDYLPDVVDATAGLGRDAFVLASIGCNVRMVERHPVVAALLEDGLKRAYLDADIGEWMQQRMKLIYASSAQALTQISPTPDVVYLDPMYPHKTKSALVKKEMRVFQSLVGADEDADALLAPAMALAKKRVVVKRPDYAEPLNNQPAHASVTTKNHRFDIYPCI

SEQ ID NO: 6860 - protein, 254 aa, Proteus mirabilis
RKDINMDFTVIADNWQYLLFGAYPDGPLEGAALTIFISVIAGIVSIILGTLGGIALAMLKGVWVNLFAAFLGFFRAIPVIMLIFWLYFLLPVVLGMEIPEITTVICALALITSSYIAHGVKAGILAIGKGQWQAGLSLGFNRWQTLWYIVLPQALRMMVPSFINQWIALIKDTSLAYVVGVGELSFLATQVNNRSMVYPMEVFLFVAFIYFVLCFSLELIANRVGKLFTTQKEKRSFWQYVIPNKKPSLSEKII

SEQ ID NO: 6861 - protein, 448 aa, Proteus mirabilis
YLSIHLLTVDAESGSRYGVYLMKNDKEDPAKMTQLSRFGQKFARHSGISRLMQDLNEGIRTPEAVMLGGGNPAHIPEMDSYFHQLLQEMVNNGSLSDAVCNYDGPQGKDAMLNALAICLKEKLGWNISAKNIALTNGSQSAFFYLFNLLGGQSAEGKKRKILFPIAPEYIGYADAGLEEDLFVANKPTIEMLPDGQFKYHVDFEHLTIGDDIGAICVSRPTNPTGNVITDDEVKKLDALAKKHDIPLIIDNAYGVPFPGIIFSQATPHWNDNTILCMSLSKLGLPGARCGIIIANEELITAITNVNGIISLAPGGIGPAMALEMLKRDDLMRLSQEIIRSFYHQRVLETIDIIRRYLPKERCLIHKPEGAIFLWLWFKDLPISSEELYRRLKKRGVLMVPGHYFFPGLEESWQHAHQCMRMNYVPEPALIEKGIKILSEEIERCLSPE

SEQ ID NO: 6862 - protein, 351 aa, Proteus mirabilis
FFGIIIVSFVKLIIRSQLVNCAISYRNNMGKRMFKKSLSPLFLLLSSLVIAGCDNAQDTSTTQSTEKQTLTIEHAQGTTEIPAHPQKVVVMNMETLDIVDALGVPVVGLPQTNVHLPKFLEKYTNENEYINEGGLFEPNYEKLSTTAPDLILTGSRARDAYAKLSEIAPSISMDIDSTRFIDSLTERTTTLGQIFGKEEQAKKLLADFNSKIDTVKAKTPDAGKAMVVLVSGGKISAYGPGSRFGFIYDVLGFEPAYTFDSPGSHGNIVNSELLLKLNPDWMFVIDRDAAIGREDSQPAKQVLDNALVRKVNAWNKDQIIYLDASSIYISGGIQTYSRLMDTINQALDQKK

SEQ ID NO: 6863 - protein, 302 aa, Proteus mirabilis
GIGMSFYHASQHEALNQNLAELDGQIQVSFEFFPPRTQEMENTLWQSLARLNTLKPSFVSVTYGANSGERDRTHAIIKDIKERTGLEAAPHLTCIDACREELQHIAQDYWQSGIRHIVALRGDLPDNSQKPDMYAVDLVRLLKDVGDFDISVAAYPEVHPEAKSAQADLINLKKKVDAGANRAITQFFFDVESYLRFRDRCVSTGIDVEIVPGILPVTNFKQLKRFAGLTNVKIPGWMHKMFDGLDNDPETRALVGASIAIDMVKILSREGVKDFHFYTLNRSELTYAICHTLGVRPQLAKV

SEQ ID NO: 6864 - protein, 542 aa, Proteus mirabilis
GIILKTRHFPWLSNQKKVKFRFHRSHLSLIMRRVHVQLTGLTSMLHLFTDLEFHTGLMLVLALIFVLFYEAINGFHDTANAVATVIYTRAMRAQFAVVMAGVFNFLGVLLGGLSVAYAIVHLLPTDLLLNVSSAHGLAMVFSLLLAAIIWNLGTWYFGIPASSSHTLIGAIIGIGLTNAIVTDSSIVDALNIPKMISIFLSLILSPIIGLVIAGAMIFLLRRYWSGTKKRRRIHLTPAEREKKDGKRKPPFWTRTALILSAVGVSFSHGANDGQKGIGLIMLVLIGVAPAGFVVNMNASGYDITKTHDAVVHLQQYYEKHQPALQHAIENTPVVSAQADPNDTDFHCNSARTPIVLNQTEQMLSGISSYDELSADQRAQMRRLLMCIADTATEVAKLPETSAQDARFLKTLSRDLLNTVEYAPIWIIISVALALSIGTMVGWKRVAVTIGEKIGKKGMTYAQGVSAQVTAAVSIGVASYTGMPVSTTQVLSSAVAGTMIVDGGGVQTKTVKNIALAWILTLPVSIALSGVLYWISLSLLVNS

SEQ ID NO: 6865 - protein, 168 aa, Proteus mirabilis
GVFMRYKSLLVALPFVFGVASANAAENVVHHKLDGMPISEAVEINAGNNLVFLSGKVPTKKSADAPEGELASYGNTEEQTINVLEQIKTNLNNLGLDMKDVVKMQVFLVGGEENNGTMDFKGFMNGYSKFYDASKTNQLPARSAFQVAKLANPAWRVEIEVIAVRPAK

SEQ ID NO: 6866 - protein, 176 aa, Proteus mirabilis
KDLIMPTPCYISIEGKTQGNITAGAFTADSVGNIYVQGHEDQMLVQAFSHVVTVPTDPQSGQPSGQRAHKPFRFTVALNKAVPLLYNALASGEMLPKVELKWYRTSVEGKQEHFFTTTLTDATIVNIDCQMPHCQDPAKADFTQLIEVSLSYRKVDWEHTVAGTSGADDWRAPLEA

SEQ ID NO: 6867 - protein, 309 aa, Proteus mirabilis
KIIINTLYIPISLFLENCKFIKKTLIHIYLTLFLCNTICHTNEFINESRLIYLLYIDKSNGSISMDVNFYVTCIGDALKSQMARDSVLLLEKLGCRVHFLEKQGCCGQPAINSGYIKDAIPAMKNLIKTFEVNDYPIISPAGSCSFAIKSYAKYLVNEPDWAIRAEKIANRMFDLTSFIVNQLNIVDVGASLKGKAVYHPSCSLFRKMGVKEEPLTLLRHVKGLELLPFDNMETCCGFGGTFSVKMAEISGEMVKEKVHHIMDVHPDYLIGADVSCLLNIGGRLEREGRPVKVMHIAQVLMSNEEELCH

SEQ ID NO: 6868 - protein, 300 aa, Proteus mirabilis
EVIMNKLSGLIAAPHTPFAADGSVNYPVIDDIAKHLITTGVTGAYVLGTTGEGIHCSVEERKKVAERWVTASQGQLDLIIHTGALSIADTLELARHAETLDIKATSVIGPCFFKPSHVDDLVEYCRLAAASAPSKGFYYYHSTMSGLSIDMEKFLQAAGKVIPNLSGMKFNSPDMYEFQRCLRVEGGKYDIPFGVDEFIPAGLACGALSAVGSTYNYAAPLYLELIERFNQGDHQGVADCMDKVIAIIRVLVEYGGVAAGKVAMQLHGIDVGAPRRPLRPLTAEQKADALAKFKAANFLS

SEQ ID NO: 6869 - protein, 77 aa, Proteus mirabilis
NTVFCSYLISQTNYQVVCYFHDISYIPVGKIFPIVTKNKSSVSGYIKKTYNYCGVKIPMTCSFSRTSALTSPSVCLC

SEQ ID NO: 6870 - protein, 332 aa, Proteus mirabilis
DMAISASFNFQGLSPDSIWDALINIGFYPDSGLTELNSYENRVFQFMDEHKQRYVVKFYRPQRWSYSQIKEEHEFVLALKEAQVSVAAPIEVKGETVHLSNEGFYFALFPSIGGRAYETDNLFQLEEVGRTLGRIHQIGRKKSYQYRPTLSVADYLVAPKLEFEQSDLVPTQLKSQFIDAIDKIIHEVSPKLSDSTWKKLRLHGDCHPGNILWRDEVVMVDFDDSRMGSAIQDFWMLLSGSKQDQLIQLDTLLESYNEYQDFDVRELSLIEPLRAMRMVHYIAWVLKRWKDPAFPRTFVWFQEQDFWFKQLALFKGQVEQLNEPPLQLSPMY

SEQ ID NO: 6871 - protein, 467 aa, Proteus mirabilis
EIHIMVTSENRNLSQSSQISPQKTSELLFALEEKPPLPQTLFAACQHLLAMFVAVITPAILICQALGLPAHDTQRIISMSLFASGIASLIQIRAWGPVGSGLLSIQGTSFNFVAPLIMGGLALKNGGADIPTMMAALFGTLMVASLTEVLLSRFLHLARRIITPLVSGIVVMIIGLSLIQVGLTSIGGGYAAIESNTFGSPKNLLLAGSVLVVIILLNRQRNPYLRVASLVIAMAVGYILAWWLDMLPTPPEQQETPIITVPEPFYYGLSFDWHLLIPLMLVFMITSLETIGDITATSDVSEQPVSGPLYMKRIKGGVLANGLNSMVSAFFNTFPNSCFGQNNGVIQLTGVASRYVGYVVAAMLIILGLFPSVAEFVQQIPEPVLGGATLVMFGTIAASGVRIVSKEALNRRAIMILAISLAVGLGVSQQPQILQFAPDWLKTLLSSGIAAGGLTAIILNVIFPPEK

SEQ ID NO: 6872 - protein, 229 aa, Proteus mirabilis
RLNMESYMMGRKLNCIGIILIILSLLLSQVESKIDIKNSDKRFLLFISLNTFTASDKLTSLISELEYSIKQGDHPFDKVIYGYVSVFLSAYYHKNKAYSQAAQTIKKAFFYLDEVVEQNPTNWRLIYLRLRMDAFTPRYLGRCVVAKKDSQQLLENININSELIPMINYMYARALFSCEQVTQAKKIMAQLLQENEASKKIARYSFTSVPPWLSIEKTAVIQPITLESD

SEQ ID NO: 6873 - protein, 474 aa, Proteus mirabilis
KMNISRRKLLLGVGAAGVLAGGAALVPMVRRDGKFVEAKSRASFVEGTQGALPKEADVVIIGAGIQGIMTAINLAERGMSVTILEKGQIAGEQSGRAYSQIISYQTSPEIFPLHHYGKILWRGMNEKIGADTSYRTQGRVEALADEKALDKAQAWIKTAKEAAGFDTPLNTRIIKGEELSNRLVGAQTPWTVAAFEEDSGSVDPETGTPALARYAKQIGVKIYTNCAVRGIETAGGKISDVVSEKGAIKTSQVVLAGGIWSRLFMGNMGIDIPTLNVYLSQQRVSGVPGAPRGNVHLPNGIHFREQADGTYAVAPRIFTSSIVKDSFLLGPKFMHLLGGGELPLEFSIGEDLFNSFKMPTSWNLDEKTPFEQFRVATATQNTQHLDAVFQRMKTEFPVFEKSEVVERWGAVVSPTFDELPIISEVKEYPGLVINTATVWGMTEGPAAGEVTADIVMGKKPVIDPTPFSLDRFKK

SEQ ID NO: 6874 - protein, 333 aa, Proteus mirabilis
FILINGTMSQYFDPIPWAKNPHLQTLLPRIVRRTPLLTPYWQRLNLPDNDFVDLAWSEEPKTAQHKPRLVIFHGLEGNFNSPYVHGMLAAAKARGWLGVVMHFRGCSGEPNRQKRIYHSGETEDARYFLNWLKEQFGEQPTAAVGYSLGGNMLAYYLAESGENAVLDAAVIVSAPLMLEPCSTKIERGFSRFYQWYLLKGLKRNATRKLIRYPQSLPISLLTIKSIKKLRQFDDLITAKIHGFKDALDYYRQCSALPLLNQIKKNTLIIHAKDDPFMSTEVIPDITTLPKNIEYQLTEFGGHVGFVSGKLSKPVMWLEKRIPDWLSTYLEKVK

SEQ ID NO: 6875 - protein, 315 aa, Proteus mirabilis
EYLMSIFFNPAKHPHRLKPQPLGEQGERYNEDWPMPELDFLETVDKQQCILVDKEIRRRDAFSYPGFITGIIAFIMVFHFIFTEHNSKYIRFNKNLHDYTLEYKAQYEDKAQRDKLPSFILDKYAPYFNQEKLSILDYIHVYFEGHITSKPYQDTLFFLAASFVPFFLIGVGGYQSFFKKNPILVFNRERNLVYTWRKNKVFIARYPEIGIGKIGKTLTFQLFGLDKSKQTLVSELFFPNVYVYSVYNTSTDYHDQRFINFINTYMREGRDAIIPFDYHRKKPKVYFGKNPPPADFEQQVEQILAKLDQEKEHHA

SEQ ID NO: 6876 - protein, 249 aa, Proteus mirabilis
NNIIRSYISKKESSEFNMALIEKMTKDIQQKGGLIVSCQPVDNSPMDKPDIVAAMAQAAVNAGAVAVRIEGIDNLKATRPLIDVPIIGIVKRDLPDSPVRITPWLNDIEALVAAGADIIAFDGTDRLRPVPVKALLEHVHRLGKLAMADCATFNEGMYCHQLGTEFIGSTMSGYTGGEIPKLPDLQLVTALAEQGCRVIAEGRYNTPMMAARGMQAGAWAVTVGSALTRLEHVCEWFTQALKWQQELDR

SEQ ID NO: 6877 - protein, 539 aa, Proteus mirabilis
RRIMMRSSKKQTGLLTATIGLLALAISAGVQAKTLVYCSEGSPEGFNPQLFTSGTTYDASSVPLYDRLVEFKLGTTEITPGLAESWEVSDDGKVYTFHLRKGVSWHSNKEFKPTREFNADDVIYTFMRQMDPNHPYHKVSGGSYEYFTGMDMNNMIEKIEKVDDNTVRFVLTRSEAPFLADMAMDFASILSAEYADNMMKAGTPEKVDLNPIGTGPFQLQQYQKDSRILYKANDKYWGKKPDIDRLVFSITPDASVRYAKLQKNECQAMPYPNPADIAKMKQNKDIQLLEQPGLNVGYISFNVEKKPLDNQKVRQALSMAVNKDAIIEAVYQGAGQKAKNLIPPTMWGYNDDIVDYEYNPEKAKALLKEAGLADGFTIDLWAMPVQRPYNPNARRMAEMVQADWEKIGVKTKIVSYEWGEYLKRAKSGEHQAVMMGWTGDNGDPDNFFATLFSCAAKEQGSNYSKWCYKPFEDLIQPARITADHDKRVELYKQAQVVMHDQAPALIIAHSTVYEPISKKVENYVVDPLGKHHFNNVSLK

SEQ ID NO: 6878 - protein, 169 aa, Proteus mirabilis
MMIITALMISFLRNLIITPYFVGSSMNDEHKIFEKIKASLNRASFIIDLRSKIEDKISAVVKKLEVITNNKVKVSFEDNNKSNIHFINSERLVYINNADLSKEGGFILFGYSFSKINGFPIEIETEIESFHAEDIENLLHIIVNIIDNESIRIIELTHHTIYNKLINHQ

SEQ ID NO: 6879 - protein, 959 aa, Proteus mirabilis
SQVIFVYCVAMWHSSHINEPQNNDEQIMVQIAENPFILVDGSSYLYRAYHAFPPLTNSKGEPTGAMYGVLNMLRSLIIQYKPSHVAVVFDAKGKTFRDELYEEYKSNRPPMPDDLREQIEPLHEMVQAMGLPLLSITGVEADDVIGTLALKAASDGRNVLISTGDKDMAQLVTPNITLINTMTNVILGPDEVKEKYGVPPELIIDFLALMGDSSDNIPGVPGVGEKTALGLLQGLGSLEDIYQQLDKIATLSFRGAKTLGAKMVEHEKVAKLSYQLATIKTDVALDKTFDDLVVNEPNLDKLLEMFTRYEFKRWISDLQNGGWLAQRSSRKAPVPYSAEVATPKEQPAADNFPLISQENYESILTHESLMRWVEVLKKAPAFAFDTETDSLNNIDARLIGLSFAVEPGKAAYIPLRHDYLDAPEQLPVDEVLTALKPILEDKTILKIGQNLKFDRGIMENEGIELNGIYFDTMLESYVLNSVSSRHDMDTLAEKHLNHKTTTFEEIAGKGKGQLTFNQIEVEQATLYAAEDADITLLLHQALYPQIEAIAPLKHVYHDIEMPLVPVLSRMERKGVLIDAQVLAMQSQEITQRLAEIEKETFALAGQEFNLSSPKQLQEILFEKLNLPIIKKTPKGAPSTNEEVLEALAHSHELPRLILEHRGLAKLKSTYTDKLPLMVNSKTKRVHTSYHQAVTATGRLSSRDPNLQNIPVRNEEGRRIRQAFIARDGFKIVAADYSQIELRIMAHLSQDKGLLDAFAQGKDIHRATASEVFGIPLDEVTSEQRRSAKAINFGLIYGMSAFGLSQQIGVERKEAQRYMDLYFERYPGVLDYMERTRKQASQQGYVETLDGRRLYLPEINSKNAIRRKASEREAINAPMQGTAADIIKKAMIAVDNWICHECPDDVHMIMQVHDELVFEVRESYLEKANAMIHKLMESSMELAIPLKVEVGVGNNWDEAH

SEQ ID NO: 6880 - protein, 843 aa, Proteus mirabilis
YKVIIMNRKKIVSFKINLLVFSVLSTLNMATVVQADPSAHIVVQQQQKNSSVDILNIAAAINGYSSNSLTSFDVSEAGLILNNSPDGADTQLSGHIDGNSNLSSGAAKEITLEVNAKKAITLNGPVEVAGTKARVILSNPAGIICSSCNFLSADRVVLTTGKVNTQNDTVDSYKVEKGNITVKGNATFDKSAQQIDLIARNVSIETPLDASGINVNVITGANEVKAQDNTVVAQKPTGVASKYSLQIVKNAGVRSSSLKFIGTEANSPLKNNGNVETAGGGIELIHSGALDNNKGNFLSEGDIYFAFDKGVTNSTGEIQSTKTISIETKEAKVDNISGGNISADGNVTINSGEFKNNASYIASKDKLDIQTNGKPITNTATVGEGVGISATNGIKINSGLFNNKEGEINSKSVIDINTNLKDFNNIDAYIDASGDISINSGAMNNTHSRLRSVTRVEIDTNGKALKNTGMTADTASDDSLGILSGLDGMTVNIAGLNNDQGIIATDGDMNFTNKGDITNKWGHIKSGGYLTFSSDKIKNLYGGLASKTGANVTFSQTLDNNFGVFYLEGDSVTISAPYINNNKGVIKGDAIYFKTDKFNNTSGFVITEQKLEIDTPELTNNSSLDFKTEMGFYLGQPDQKGGLISKGEMKLSGNKLVSNKGRIVTENGDMELKFTSVDNTSGTIASHKNAFVVTSTFTNSQGTLFGQDKLTLQTDTLKNNSTGSVESNTLKGVIASSGDTEVTVNRDFENNGVISGVEHLRVNINGKYTNASNSIMSGKNSFELGVTGNIINRGILNSIKDTTISGENITNEKSGIIVGRESITIDNKGTFTNKGKVVGPLNK

SEQ ID NO: 6881 - protein, 64 aa, Proteus mirabilis
ANSIAPKLLNGMYLTFDIVNTNDFYSVSSVKQLGFLFFIPPQFLLFPFPSFKYSKAGKPYGYPA

SEQ ID NO: 6882 - protein, 251 aa, Proteus mirabilis
SLPIQFIHCYALFSYFTGMFTMLITIAGYCWLCRQPLRYGNHSICSSCIRHLPQQNNRCPGCLYPSTHSMILCGRCLRSPPRWKQMLTVTDYRPPLNKLLHLYKYHPRPQIALCLAKLFLLRWLAHRRENLVRKPEQIISVPLHRHRRWRRGFDQVEAIAKPLARWLNCPYHPNTLIRTRATLAQTHLNAKQRQQNLDNAFIVNRTVSVAGKDLALIDDVITTSATLNAIVPLLFRAGARSVEVWAICRTL

SEQ ID NO: 6883 - protein, 207 aa, Proteus mirabilis
NITMELNLCWWNIGISPPTKSKQNVKTEKVGLAKKYLEELIIKKTLDIIALSEVSENESYAFKQLATQLKMGYIDLSGKIGRIIIDISLIYQMNKLEFISSKFLTKLQPDNRMVRVGVAVVFKEIEHQKIITLFLSHWPSILSANDTTREVAAAGLRSSINKLFENNGDDVQFICMGDYNTEPYSNAMLNILYATRDYHLIKKKTII

SEQ ID NO: 6884 - protein, 587 aa, Proteus mirabilis
ICAIRHSVFLSFWQTRCIVLASKLLGYFTWHRICFMSDIALTMVMLSLAGALGLWIGNVKIYRVSLGIGGVLFGGIIVGHLAQRYGLVLNTQILHFIQEFGLILFVYTIGIQVGPGFFSSLRVSGLKLNAFAILIILLGSLVTAFIYHLFNVPLPIILGIFSGAVTNTPSLGAGQQILTDLNIDPAIISQMGMGYAMAYPMGICGILLVMWFIRVLFKINIEREAKHFNHQQNSTKETLHTINIAIRNPNLDGLLMQDIPLLNEDALVCSRLKRGDDIMVPMPSTIIQLGDLLHIVGSREDLNKVRLILGEEVDASLSTSTHQLQSVRIVVTNDAVLSKRLKDLDLKRKYDVVITRLNRAGIELIPSNNSMLQFGDILNVVGRPGAIEAITVLLGNARQKLEQVQMLPVFIGIGLGVLLGSIPIFIPGIPVALKLGLAGGPLIVALILGRIGTFGKLYWFMPPSANLALRELGIVMFLAVVGLNSGGGFIDTLIYGQGLSWIGYGIAITLLPLLIVGIMARLVFKLNYLTLCGVLAGSMTDPPALAFANSIHQNSGAAALSYATVYPLAMFLRIITPQLMALIIWAL

SEQ ID NO: 6885 - protein, 356 aa, Proteus mirabilis
NGAMGVFNMETADLPDNTLILDSLIHSVLVINQEFIICYANHAALQLLAQSRRKLFETPFSALFSYSSFDEQLMRETLANGQSFTDNEVILVINNQSHTMSLSAQPISEQHILLELAPMDSQRRLSQEQIQQAQQMAARELVRGLAHEIKNPLGGLRGAAQLLAKSLPDPALTEYTQVIIEQADRLRALVDRLLGPQHPGTKTFQSIHHVVERVAQLITLECPENVTLLKDYDPSLPELSHYPDQIEQVLLNITRNALQAVEKTGGTIILRTRTAFQVTLQGERHRLVARIDVIDTGAGIPPHLQDTLFYPMVSGREGGNGLGLSIARSLVDQHAGKIEFTSWPGNTEFSIYLPIK

SEQ ID NO: 6886 - protein, 554 aa, Proteus mirabilis
GRKMKNKHYAISLLTLLSPNVLAAAITEGGEKQPINFQAIIMFLIFVGLTLYITYWASKRTRSRSDYYTAGGKITGFQNGMAIAGDFMSAASFLGISALVYTSGYDGLIYSIGFLIGWPIILFIIAERLRNLGRYTFADVVSYRLSPKPIRTLSAIGSLVVVALYLIAQMVGAGKLIELLFGLNYHIAVILVGILMVLYVLFGGMLATTWVQIIKAILLLAGATFMAVMVMKAADFNFNTLFKEAVNVHQKGFSIMSPGGLVSDPISALSLGLALMFGTAGLPHIIMRFFTVSDAKEARKSVFYATGFIGYFYILTFIIGFGAILLVSPNPLFKDAAGALIGGTNMAAVHLADAVGGNFFLGFISAVAFATILAVVAGLTLAGASAVSHDLYANVIKNGQADERQELKVSKITVVILGIVAIGLGILFEKQNIAFMVGLAFSIAASCNFPIILLSMYWKGLTTRGAVIGGWSGLIVAVTLMILGPTIWVSILGHDTPIYPYEYPALFSMIIAFIVSWLFSITDNSSLATQERMKFEAQFIRSQIGIGAEQGKPH

SEQ ID NO: 6887 - protein, 445 aa, Proteus mirabilis
HNEIGGKMSQQWTSRVGHILAAAGSAIGIGAIWKFSYVAANNGGGAFLVVFLLFSFIIGLAVLLAENILGSSTHAEAVNAFKKMMGRNWVIIGVIGVFSSWCIYSFYSVVGGWTIGYTIMAATGELNITDSSELTGIFTRFISDPLWPILAHLVFAGLTCFVVLAGVQRGLEKAVKIMMPLLFIIMIILIIVGISLPGSSEGLKLFLYPDFSKLTPQGVLDALGLAFFSLSIGLGIHITYSAYLADNKTIANSSMWVVILSCLVCVLAGLMIFPALTAAGLEPNAGPGLTFMTMPVYFANLPGGNILAVTFFVLLLMAALTSAISLLEHIVAYVQMRFQWTRRRAGLVVTASIMLMGIPVSLSFGPMSDVTLGGKTLFDLLDYLTSNILMPLFGIAMCLIFGWSRRANAVIPDNITGAKRQCLLLVWRYIGPICIGIILVHGLIG

SEQ ID NO: 6888 - protein, 239 aa, Proteus mirabilis
GIEMTEKKLKGIRAIAFDLDGTLTDSAVGLTEATNYALKAKGFPTVDKHHVTIWVGNGVDMLLKRALHHCGVKDVTDTLLKEVRDLFDECYANSVKTGSNLFPHVKETLEKLASYSLSLGIVTNKPTPFIQPLLKQLGIDNDFSLVLGGDDVKQKKPHPAPLYLTMGTFGVKKEELLFVGDSRNDIIAAQAAQCPCVGLTYGYNYGEPIADSKPDFILDDFADLLSILDITSMTTVEQN

SEQ ID NO: 6889 - protein, 133 aa, Proteus mirabilis
RNRMKKYIFTAIILSLTASYASAETAVNGCDIKKQNIQRQIDYAKMHGNQYRVQGLERALNKVERYCTPEKVVEDTRLELREKQLEVKERELELKEAQLKGERDKITKREDKLAQAKAELKAAEEELELLTKK

SEQ ID NO: 6890 - protein, 243 aa, Proteus mirabilis
QCRILSPTNAYLANPKRAAIYVYTAQKDATSNCHWFSFASLGDSMYQINFLPWRQALYRHQAQRWLYWSMILVVITFSACGYYAYYLVQQVKTLSLLQSQYQKREYSLQKQYHNDQHEQKVTRLYQQRYWHYYQHWLHYLNYLAFFQALETLLPTEGYIAQFSENDATFSLQVRLPCEQALTFISKVNQHPNLTSLTLSSFQQSKQDPRYSEIRFSGKWQSWQYQVSQHRHSEQDVDNNENKD

SEQ ID NO: 6891 - protein, 98 aa, Proteus mirabilis
QSLIRRKNTMRSLVNGRKIILENDTTNTGGTVLTGSSIAKQTQGIACVGDPVYCPACKKTGTIIEGDNLMKIKGIPVALEGHKVACGCSDGCILVATD

SEQ ID NO: 6892 - protein, 499 aa, Proteus mirabilis
LTLIFYFSSFNIRVIISMDNKQHYLDIAAGQGKKEPSRIVAFPAQPLNYALIEQRLEEQTEYTDGEISYLSDDLDEGFFYHCQHGDDELHFFICLLPRSEDYQIRPMYATDEMTPELLAHANATTQDILLETMFSDTLHPLASYRHQLNLLNIIAPEMILALDESAAGKGLTPEWIRFQLETPDLYPEVESLYVIHAVYDTENDPPTMFWFHTHGLQRCGLTEVDLVIPSMLESYYGIPDLFRCFVNNSINNRQIEFGEPMLCGQTSSGLEYLVALPFEEGIRHVNQSTPLDSLRPLEEMRYNTQGAPHGVFLGDMADRDEYHQHPSSMLFRTNEENPILETFFKGYEEQQAMMLLRSNEETYEMAEKAKRRWQYFLSMFDNYHQPPVEKKTGFLAKLLGSKESNEETESPWQFMIKFGIPYGDKEEKELEHMWFIPQSREGDRIYAKLLNVPFYVQEMEEGGIYPIDIAFITDWVISYEGYSYTPNTIYQLFSHQQTH

SEQ ID NO: 6893 - protein, 189 aa, Proteus mirabilis
GGMMSNASNVLLVYVHPEPRQSIANKALLRAVRDLENITIHDLYATYPDFFIDIHREQALLCQHQVIVFQFPLQTYSCPALLKEWQDRVLTRPFANKVGRAQLKGKTFRCVVTTGEPEHAYQHNGKNHYTLSELLRPIELMAEMCGMRWLSPMIIYSARQQSKTTLGHISDAYRQWLQAPLEGEHADGR

SEQ ID NO: 6894 - protein, 149 aa, Proteus mirabilis
IMPITEFSSIISTGTQGGLQMQCASRQFQLLLDEPISLGGNDTAMTPVEALLGTLGACKCIVAKSFARLHHINLHNIRIEVKGELDIDGFMGKNKQAKIGFSKITTHFYIQADNSKTEIEAFIAFIERTCPILDTITNPPECETLYHLE

SEQ ID NO: 6895 - protein, 133 aa, Proteus mirabilis
SNTMNLTYCLLVTGPHYGTEQASSAYLFAKALLEKGHHIAQVFFYREGVSNANQLVSPASDEFDLPKSWIALASRYNIPLQVCVAAALRRGVVDEQQAKEQGLLSSNMATKFELSGLGALAQAMLTCDRVVQF

SEQ ID NO: 6896 - protein, 229 aa, Proteus mirabilis
EGAILRNIVVSKEKFERSKPHVNVGTIGHVDHGKTTLTAAITTVLAKTYGGAARAFDQIDNAPEEKARGITISTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPVIRGSALKALEGEAEWEAKIVELAEALDSYIPEPERAIDKPFLLPMSSPRG

SEQ ID NO: 6897 - protein, 124 aa, Proteus mirabilis
IGWIDKSHAKGEDASTLMGVLTAGDYVSDVDPMTYLTVLSKEEAYRRWDYYGSISKYKNKLFKPLIFPDPAIYPNNARPYFVSLPCYLDRVKPIEDIRNNSILIHVKDTTGINIGAESEWIKIE

SEQ ID NO: 6898 - protein, 194 aa, Proteus mirabilis
ANGILKMKKQLLSALFISGIFSISTVQAHENTSLDKTTISAGYAQIKIAGQSGIMRGGNLSIRQEFNQQLGIMAIATYAQNEYDLNKPLKQLIKDVDARYYSVMAGPTLRLNDYISVYGVAGMAQIEFKGLDTRQVPESIIKKNAFSWGAGVTINPIDMLSVSVGYENSRYKMNKLSDNKLIIDGFIANIGYSF

SEQ ID NO: 6899 - protein, 87 aa, Proteus mirabilis
LSVFLLKSGIIFFERGFIDLVHLGMILFQRIIIMLFHTNNPIWKIIVPGGAAGLQIQMGPPAVLGRFDSCDLPPIKFITPPKTQSIP

SEQ ID NO: 6900 - protein, 242 aa, Proteus mirabilis
SVHFCDQDNLMSTIIDTFIAPTCHDKIEYLYQDEHLLVINKPSGLLSLSGKNPQNIDSVHYRLVPLFPECTLVHRLDFGTSGVMVIALNKAINRALCQQFSQRTVTKAYDALLCGHLQNDSGVIEAPIAKDPQHFPRMSISTTQGKAARSYYQVIERFYQTLADGTRLPLTRVRLTPETGRTHQLRIHCQYIGHPILGCDLYGGLLLSGTEHTPRLMLHACELHFIHPVSEQPMDIYLPSPF

SEQ ID NO: 6901 - protein, 543 aa, Proteus mirabilis
MVNFLFYMEKGDNDKSMSQVINFSLLFILSIVPALLAGSTLHIEQKFSMVIIGWLLMLLCAGIYRFTIGKVITFIVAALWSLNLSISLFFYREHDIPFSSSIAETFINTNGSETVGMLSYNKYYVLFYIVIFTSFFYLIHISARYLNNKTNKRCLIAIFILIILISLYKNLAIRSESKTQLLAEYYLLNTPFYNAAALVRTFHENRQIKKITSEKVNFNYDKVDQKTEIYILLIGESVRRDHLGIYGYPYDTTPNLEKEKNNILLFKQAYSPAPVTILSVPISLSNINLTELYDKKHYADNIISLANHAGFKTYWLSNQGKGNPKTSVISVIANMAQHKKWNEFIGYDEELLPFLDNALNDNSSNKKLIVLHTYGSHEPACNRFPSTYLKTFSQQEDDNCYDSSIAYTDKLISQIIEKIQDKPASILYFSDHALQRLDKNREVRYHHGVNSPRQEAYNIPLFIWYSASATRPNINEENLNKPFSTADNYWLLSQWLDIEHNSAKKCYSPLSECYQTKTSMMVIDGNKKLLNYALLESEEQAPQ

SEQ ID NO: 6902 - protein, 700 aa, Proteus mirabilis
RSNFPMKGKLLDAIPLTTLHGVGASQADKLAKIGLVTVEDLLLHLPLRYEDQTHLYAISDLLPGIPATVSGEILRTEVNFGRRKMMTCQISDGSGILTLRFFNFTAAMKNNLAQGKQVIAYGEIKRGSRGPEIIHPEYKIKVAGSEVKLQETLTPIYSTTEGLRQTSLRKLIEQALTLLDTCAINELLPDQFIYGLPPLATALRTLHNPPPDIAFAELEKGQHPAQKRLIIEELLAHNLGMLNARAGAQSYRAEPLLMPHGSTLREQFLATLPFTPTTAQQRVVNEIEQDLEKNYPMMRLIQGDVGSGKTLVAALSALRAIANGKQVALMAPTELLAEQHALTFRKWFEPFGIQVGWLAGKQKGKAREAQQNAIANGEVSIIIGTHAIFQEQVKFHSLALVIIDEQHRFGVHQRLALWKKGEEQGFHPHQLVMTATPIPRTLAMTAYADMDTSIIDELPPGRTPVTTVAIPDTRRNDIIERIRVACSEENRQAYWVCTLIEDSEVLEAQAAQVIYDELTIALPEIKIGLVHGRMKPAEKQAVMADFKENKLQLLVATTVIEVGVDVPNASLMIIDNPERLGLAQLHQLRGRVGRGAVASHCVLLYKTPLTQTARLRLQVLRDSNDGFVIAQKDLEIRGPGELLGTKQTGNAQFKVADLLRDQALIPEVQRIARYLHQHYPKHSQALIERWLPAKTQYSQA

SEQ ID NO: 6903 - protein, 77 aa, Proteus mirabilis
SGPVFIATFNGLSPSSGEQAVKTNEVQAKSTTNNNFLIFSPIIDHITLIIYNLLLLLSLMFLLCYQGEYLYYMPTCI

SEQ ID NO: 6904 - protein, 255 aa, Proteus mirabilis
GTPVKQTQRHDAIIELVRLQGYVSTEELVEHFEVSPQTIRRDLNELAEKNKIQRHHGGAALPSSSVNAAYHDRKIMWSDEKSRIAQRVASLIPDGATLFIDIGTTPEAVAHALINHKNLRIVTNNLNVATLLMDKEDFRLILAGGEVRTRDGGIVGEATLDFISQFRLDYGILGISGIDMDGSLLEFDYHEVRTKRAIIENSRCVMLVTDHSKFGRNAMVNLGNMNLIDYLFTDQEPPSGIQKIIEQHNVQLELC

SEQ ID NO: 6905 - protein, 116 aa, Proteus mirabilis
TMAVIPKNYAKLESGYREKALKLYPWVCGRCAREFVYSNLRELTVHHIDHDHTNNPEDGSNWELLCLYCHDHEHSKYTEAEEYGSTVVAGEDAQDDVGQATYNPFADLKAMLNKKK

SEQ ID NO: 6906 - protein, 133 aa, Proteus mirabilis
TMAVQRLFCTAKHQRGGMMLDIENCVDSSATDDEFEEIIMGLIINSGQARSIAYAALKKAKQGDFAQAKKMMEQSRAALNEAHKIQTRLIGDDQGLGKTKVSLVLVHAQDHLMTSMLARELVTELIELHEKIK

SEQ ID NO: 6907 - protein, 291 aa, Proteus mirabilis
VDYVIMPTLTKIAWIKPGMATNQRKIADYILEHPEKIVTLSSQQLAEIMGVSQSAIVKFSQKIGFKGFPSLKLAISEDLGRKNANSEKNSSILHNQIDSEDSLVVIAQKLAQEKNNSIRDTTRQINYHQFEQVIQQIDDASRVQIIGIGGSGLVARDLSYKLQKIGITTLIETDHHVQISVAQMLSPRDLQIVISYSGKRKDMLVAASVAKKQGAKIIAITGEKHSPLGLMADYILETIADEGEWRSAAISSRTAQNTITDLIFMALLKKRDENAKALVLSSQALINSLDD

SEQ ID NO: 6908 - protein, 595 aa, Proteus mirabilis
LMYVCRSLLFILQINEIGKAMLKRIKISSGLMFILILFCAIQLFSGATGIRDAYLTNKRISQLADGFEQIKTMDYGYAALNKLREDMLNVMFDAHLTPDLAESKITDFLSSYPQRKKEVSSIITQYFTSAENADFDREKVAKMKKLFQRVIYDLDQLVSCLEIRDYYGFQSLYAHNTNERFTQSLYEATDHLSDNVVNHAIEAAQGNYQRALIFAFIFMSVFILFTVFVMLWIRHHIVLRIKQVIDYMSDISQGNLLENSTIKAKGNNEIDQLINGIQYMRSELSLIVNAIRGTSHHIYNGVQELSAGNNDLSSRTQEQASALEETASSMEQLTATVKNNTESAREVSHLINQTSNIASKGGDVTHRMVKTMNDIAQSSQKIGEITTVINSIAFQTNILSLNAAVEAARAGEQGRGFSVVATEVRELAQRSAEAAKEIKELIDASINRVKQGNQLVEQVSTSMDEILTSVKHVESSMTEILSASEEQTRGISQVSLAVTEMDKATQQNAAMVEQSSAVASLLTEKAGDLEQIVEQFKTAESLFSKNSTLAKPVEKSANIGLSLIKENQQDSRIKEPKNHKQSTFKEDEDDDWTSF

SEQ ID NO: 6909 - protein, 68 aa, Proteus mirabilis
LLSVYWLFIFININFMIIYQWDKILLLCYILIFNGVLSAVILRNKLFQKTKKNLSIIYNLFKNRCAYT

SEQ ID NO: 6910 - protein, 68 aa, Proteus mirabilis
MPYVNIKITREGATAEQKEQLIAGATQLLVDVLGKNPATTVVVIDEVDTDNWGIGGKTVTDLRASAKK

SEQ ID NO: 6911 - protein, 339 aa, Proteus mirabilis
SSNVMQKVNSSMISKYTGAVQPKKVRLSPMARIWLLLGVSLLAIALFMTINLNGNISYILTHRAYIILTMIIVAFAAGVSTILFQTIANNRILTPSLMGLEALFVLLQTLFIFFEGDMPASWMANLTKFFLESALLVLFSVVLYRWLFSSVRFNINLVLMIGIILGTLFRSSATLLQRLMDPNEFSVLQSRMFATFTRATPDLILCALAIIVVVGVLLWRMRYSFDVMALGQANAINLGINYRKQTTYILLLISVLVAVSTALVGPLTFLGLIVANLAYHISGSSQHRFLMPVAFLLGTIALIGGQLILEYGLKMTGTLSVVIEFIGGMFFIYLVLRRL

SEQ ID NO: 6912 - protein, 198 aa, Proteus mirabilis
TIKVKDPCMLKRFFVTLVTACTLTTTSLAMAATGETFVKLVTSEGNIELSLDNKKAPITTKNFIQYVEDGYYNGTTFHRVIPGFMIQGGGFTADLQQKQTREPIKNEADNGLRNLKGTIAMARTSDKDSATSQFFINVADNAFLDHGQRDFGYAVFGKVVKGMDVVDKISQVQTRNIGPYQNVPVKTVTILSAEVVKE

SEQ ID NO: 6913 - protein, 289 aa, Proteus mirabilis
KNKVRRMMMHSLKAQAEIRMVYENQLFNGKNFHVFIYNKTESVSGLHQHDYYEFTIVLTGRYYQEINGKKVLLERGDFVFIPIGSHHQSFYDFGVTRILNVGISKAFFDKHYLPLLPAYFVASQVYALKNEFLSYIESVISSLNFRHTEFNEFIEIVTFNVVNRLRHYRDDGIEDDIPLWLKDAIDGMHDKSRFGENALANMVQLSGKSQEYLTRATRRYYDKTPMQIIHDIRINFAKKQLEITNYSVTDIAFDAGYSSPSLFIKTFKKITSLTPNSYRKNLYSIKETN

SEQ ID NO: 6914 - protein, 279 aa, Proteus mirabilis
IIRVIWSIIGEKMRKLLLVVLLACTSLVLTACSPDEGDKPLKVAINTGPDQQIWDEVVKLAKEKQGLDIKVITFNDYVLPNEALRNNDVDVNAFQTVPYYEAQSKERGYQFEIIGKTFIFPIAAYSNKIKTIEALPDGATVAISNEATTLGRSLLLLQAQGLIKLKDGVGYLPTTLDIIENPKKLKFAEIDTPQLTRTLSDPNIYLSIINNNFSSQVGLLAKRDGLFMENTDSPYVNLIVARAIDKDNERLKKLVAVFQSDEILQKAQEVYKGDAVKAW

SEQ ID NO: 6915 - protein, 202 aa, Proteus mirabilis
GFLVSGRVGNIKYLNIGIANKMSITMKIKTNWVIYFVLLPFWQKALLSLAPSIIVSLLCYLFSFSGYQQDITAQQQLISQHQTQIQQLQSILHSSPAIALLKALQHDYKLPPQTGSAYQRLQQIIDNHHLIPHSWQHSVDNSFKLRFSLSYSQLLTLLAHLHQAGCALSALLISPIPPDLLSVELNLVDITTPNVLAPLKSE

SEQ ID NO: 6916 - protein, 323 aa, Proteus mirabilis
KWQVMPLTYCKEFIMSQQKYVGVWPVMLTPFDTKGEIDWASLERLVDWYIDAGVHGLFAACQSSEMFYLSDEETQALTRFIVEKADGRVPVVASGHTATALSQQKEQLQAMASTGVDGVIMISNRLAQVGESDDKALETLQSLTHAVPKEIDLGIYECPYPYKRLLSEEIVEWCAQSNRFTFIKDTCCSLPLIERRLALSKGSRLHLANANSQTLLASFQAGCQAYSGVMANFHPELYVWLYENWQDKPEQAALLADYLSTAAMTETLDYPACAKYHQRLIGNFATLVCRSRNSSQFENSFFPSAVNSMTALGENMKKWLSLN

SEQ ID NO: 6917 - protein, 164 aa, Proteus mirabilis
SYLLVMAKSNYITRDGWHALDKELKYLWKEERPRVTQSVSEAAAQGDRSENAEYIYGKKRLREIDRRVRFLSKRLDELKIVDPDPRQEGKVYFGAWVTLEDDDENIKTFRLVGPDEFDPAKQWISIDSPVARALIGKKVDDEVSVQTPGGIVNYCVLSIKYYSE

SEQ ID NO: 6918 - protein, 581 aa, Proteus mirabilis
RFLLFSLPLNLLNKRDVMFYKKLPSLNLLVISISFAFIHNSAVANNVIVDAGKSANTTVSKNGDGSETISINKANDMNLSVNYFEQFNVGKEGVNIDNSEAKAKVILNEVTSKKTSSLEGKISVLGQDAELIIANPNGIDCYGCQFSGSDKVMLISGKLDSITGKKIHLSDGYVNLKNVNNFNEKQTINVFSNRINILGKNKIPVFNVINGYETVSFVDYDWKGDQGKELSKDNQEGFSILENSLLKTDLFSLQGGIFNLDGDLITKKINIIRNKEINANEKSVFGIINKKNEFRAYNEVDLMFMLASMKLYFLEIDAKKSAEIALELEALEEKIMELEPHNIHKNRLKKIRELAAEARRVADQQQAEYNKIQSAVLKIDEAKQAEKRKLEAEGKEIGSALQYIESDNINFKGKLAIINSEVLFNARNINVDIDKTISYVRNSGVSFNAHQDNNYSGRFALINSSIRFLGYRNIPIGDGNDDNSLDKNKLNDINLNKLSMLGFGQIFAHGDNINITDVKFKETLSDDGLSKTYIDLIADNEINIKGQFKTSLINKYSLFKFASKITENDKVIFDINPHKTK

SEQ ID NO: 6919 - protein, 158 aa, Proteus mirabilis
SMLFGHLSDLATMPEMNPALRHAMEKALALDPASLASGSYKIDGETLFMNVMTFETVPREQKQAELHQRYIDIQILLSGEETIDFGIQGSAQDVTPYNETDDYQLTDNIIHRQTLSLTPNMFAIFMPYEPHKPGIAQKNEASTLKKVVIKLDVAALTH

SEQ ID NO: 6920 - protein, 548 aa, Proteus mirabilis
KSLFIRSKTMNVKGLTPKDLEQYGIHDISEVIYNPSYDLLFEEETKPGLTGYEKGTLTSLGAIAVDTGIFTGRSPKDKYIVRDDVTRDTVWWADQGKGKNDNKPLSPQVWADLKSLVTEQLSGKRLFVVDAFCGANADTRLKVRFITEVAWQAHFVKNMFIRPTQEELENFTPDFIVMNGAKCTNPNWKAQGLNSENFVAFNLTERIQLIGGTWYGGEMKKGMFSMMNYFLPLKGIASMHCSANVGESGDVAIFFGLSGTGKTTLSTDPKRKLIGDDEHGWDDDGVFNFEGGCYAKTIHLSKEAEPDIYGAIKRDALLENVVVLADGSVDFDDGSKTENTRVSYPIYHIDNIVKPVSKAGHAKKVIFLTADAFGVLPPVARLTPEQTQYHFLSGFTAKLAGTERGVTEPTPTFSACFGAAFLSLHPTQYAQVLVKRMQACGAQAYLVNTGWNGTGKRISIKDTRAIIDAILNGDIDKAETQTLPVFNLAIPTALPGVNSEILDPRDTYADKAQWDVKADDLADRFVKNFDKYTDTPVGQALTKVGPKR

SEQ ID NO: 6921 - protein, 73 aa, Proteus mirabilis
TTIFSIVSTVSFTCFEPILILLLDVLINALISFAASALRCAKLRTSLATTEKPRPCSPALAASTEAFNANMLV

SEQ ID NO: 6922 - protein, 176 aa, Proteus mirabilis
NEVFMAVLTLLHFPDERLRKVATPVEKVDDEIRTLIDDMIETMYAERGIGLAAPQVNVSKRIVVIDVSENRDQPIALINPEIISTEDEIMDMMDGCLSIPDSFAPTQRFRYLKVKALDRNGDEIELEAADLFAGCIQHELDHLNGKLFIDHLSPLKRQRIEKKQKKLSKLNSTQVA

SEQ ID NO: 6923 - protein, 392 aa, Proteus mirabilis
FISFLFIGDVMKYFEMENKANVLFGEYNGVTLPKRYTNEHEAYFSVRNSILMTDFSHYGMVKISGEDAWRLLNYLISADISSIRDEQLLYTLLLDKAGKIISDAYVLCDNEHYFLISEWMNSDAICQQIKKVLDKQDERGECYQIDAIASLTPDWRMICLEGPYAWEILSEIVGMDIIGLPFHEFMYVDEDVITMRVGKHGEYCYHIMGDEEKLMSIWRHLCTLSEKFDLKIGGVDDLKNIRLENPCWEPQVINPFSRCPIELQMQWAISYDKDAFIGQDAIKQRADNGVDQKIVGARIINMPQNAAILQGDAIYYQNEQIGVVIQVGYSFILKEHIARILLKREFAYVDIDDYKIKTAYGDIDFITTSIPFVNNLSLIINPTEDSYLERHQ

SEQ ID NO: 6924 - protein, 289 aa, Proteus mirabilis
MNTLAIDIGGTKISAALISRDNQLTQHRQIATPASPSPTQLYEALVSIITPLKNHADSVAVASTGIICNGILTALNPDNLGGLNDFPLMETLSTLTGSPCWLLNDAQAATWAEYYHRRDTISDMAFITVSTGVGGGIVQQGQLLIGKRGLAGHLGHTLADLRGPRCGCGRYGCVEAIASGRAIASQAEGELAGKDAKAIFSAFHQGNLQATTIIKRSANTIANLITNIKATTDADCVVLGGSVGLANGYLELVQVAMAQQPLALQVPIVSAHYHHDAGLWGAALWSREQ

SEQ ID NO: 6925 - protein, 855 aa, Proteus mirabilis
TAQFTLHGKFKVKFLKYFFIFVFACIILGAASIYGMYKYVEPQLPDVATLKDVRLQTPMQVFSADGELMAQYGEKRRLPLTLQEMPPQLINAFIATEDTRFREHHGIDPIGISRAVVVALTSGQASQGASTITQQLARNFFLTPEKKLMRKIKEAFLAIRIEKELTKDEILALYLNKIYLGNRAYGVGAAAYVYFGKSVHDLSLSEMAVIAGLPKAPSTLNPLYSYDRALKRRNLVLQRMLEENYITREEYDSAKAEPIVAKYHAPQIDFSAPYLTEMVRMEMYQRYGENAYTDGYKIYTTVIRKDQLAAEQALRNNVIDYDMRHGYRGAQEVLWHAGQTPWDDKAINDKLKGIQTYGPLIPAVVLSADAKEAQVVLKNGDKITLDLKAVRWARKFISDTAQGATPSKVDAVVHAGEQIWVRQNSENDWLLAQLPEVNAAFVALDPLNGGIIALVGGFDFELSKFNRVSQSLRQVGSNIKPFLYAAALDKGLTLSTLLNDLPISRWDAGAGTDWRPKNSPPTYAGPIRLRQGLGQSKNVVMVRAMRAMGVDYAADYLLRFGFPNQNIDRTESLALGSPSFTPMQMARGFAVMANGGYLIEPYFIQRIENADGEVIFTAEPKVACPECTDIPVIYGDTTRSIALSDDYMENVAQSQQAQPAETAPDIELEQAPLAETVKESPYAPHVISTPLAFLMHDALRTNLVGEPGWSGTGWRALRDLKRQDIGGKTGTTNSSKDAWFSGYGANIVATAWIGFDDSSRNLGRTAATGGEAGAKTAQPIWNDFMKVALEGVPVQMMPMPKGVVAVQIDRNTGKLAGDGPSMKEYFIEGTQPTEKAKSEVGTRIFEDNGESNELF

SEQ ID NO: 6926 - protein, 497 aa, Proteus mirabilis
KMQLHDFGFINYAVLFGYLAAMLLVGVYFSKRQKTADDYFRGGGRVPGWAAGVSVFATTLSSITFMSIPAKAYTSDWTFIIGQYLAIAILPLVFYFYIPFFRKLKITSAYEYLEARFDVRSRLFASLSFMLFHIGRVAIITYLTVLALRPFMGIDPVVLIVLISLLCIIYTWMGGIEGVIWTDVIQGLLLSGGAVLIFIMICFKVDGGISEIFTTTAQADKFFPTTQWRWSWTDSTIPVLMIGFLFANIQQFTASQDVVQRYIVTDSIKETKRTLITNAKLVAIIPIFFFAIGSALFVYYQQNPSLLPAGFNTGGILPLFIVTEMPIGIAGLIIAAIFAAAQSSISSSLNSISSCFNSDIYTRLSKSSPSPEQKMKVAKLVIIVAGIFSSLAAIWLVLSDEAEIWDAFNSLIGLMGGPMTGLFMLGIFVKRANAGSAVVGIIVSIIAVLAARYGSDLNFFFYGVIGSMSVVIAGTITAPLFAPAKQLSLDDSETSEN

SEQ ID NO: 6927 - protein, 873 aa, Proteus mirabilis
KIKFIAKIFIKNNKYYIGINMNSRRRRVVITGMGVLSSLAKDVPQFKQVLFNRQCNIKPSQRYLKWFKNANASEIEMALDYSDIPQHIARSLDNAALWAYRVCNEALQQANLIDNQSILDNTAMIVGVSSAGTEAFLPLFEQHIDDFSIKKAILSGGFSSCCSSVSSLLGLRGGLELVATACTASPNAIGMGYDYIQNGKNPVVLAVGTEPIYLPTFAGFYALNVMKTTPTSPFSGTPGMSIGEGAGALVLEDYQHAVERGATIYGEIVSYATSCDAYHETSPDPRGNGAVQVMYKALDNAGITPNDIDYINVHGTGTEANDRIETMSMKKVFPNIYHIPLSSTKSYVGHNIGAAGIVEIIACFICLAEDKLPPTLNFTQPRHSCDLNYVPNFFQDKKVKFFMKNNYAFGGNNCSIIASPYITDKTPTEYKAKKVVITGVGAITSIGNNIMEIITAILAGDKTGTLKPIVFASDVQKDIDNLMSVVIKDNDFEQSLGHPYFDLDIDHRLKNNACYHAITDVNPKKTLRYYDPRKAIPSGTYALFALNEALANAGRKIKRDGDNLGFIVGMSKGPQSTVNRYLQSLIPDPQKVRTSEFPGTLMNAVPTFCAITEGIKGYTTTLATGVNAALGALTYGYEIIRQDLQPQVIVGGADEHFSSISLYFQAMSKKVNLTKNATDYQVYSNASAGYIPGEGAGMLFLEDKEYAKQRGAKIYAEIIGYGKANDNTFLVDENITDRVAALCKAIQQALSEAQLSCQDIDIICGTSDGNKENDEVEIRAIRQLFYQAANHVPVVNYNAFFGLVESCAGILAISLVIHMMQSNTIIPIPYTKSFIADDIHFVTQPINKQIETALVLGSSEGCNHYAIIIRKPL

SEQ ID NO: 6928 - protein, 456 aa, Proteus mirabilis
GYFSMSKVIGSLEKVLLPFAVKIGKQPHVNAIKNGFIRLMPLTLAGAMFVLINNVFLSFGEGSFFYSLGIRLDTSTIETLNGLKAIGGNVYNGTLGIMSLMAPFFIGMALAEERKVDPIAAGLLSIAAFMTVTPYDAGGAYAVGANWLGGANIISGIIIGLVVAEMFTFIVRRNWVIRLPDSVPASVSRSFSALIPGFIILSIMGIISWGLAHYGTHFHQIILDSISTPLASLGSVVGWAYVIFTSLLWFFGIHGSLALAALDSGIMTPWALENVSIYTEYGSVEAALAAGKTFHLWAKPMLDSFIFLGGTGATLGLILAIFIASRRADHRQVAKLALPAGLFQINEPIIFGLPVIMNPVMFIPFILIQPILAAITVTAYYLGIIPPVTNIAPWTMPTGLGAFFNTNGSIAALLLALFNLAVATLIYLPFVIISNKAQTEIDKEESEEDIANALKF

SEQ ID NO: 6929 - protein, 280 aa, Proteus mirabilis
IMKLRVLATALIAGSVLFSGLAKADKLDDIKQAGVVRIAIFDSNPPFGFIDPQTKKLAGYDADIANEIAKDLGVKLELRPTNPANRIPLLSAKKVDLIAANFTITEERAKQVDFSVPYFATGQKFIARKGVLTSPEQIASLRIGADKGTVQEITLRERYPETKVISYDDTPLAFAALRNGNVQAITQDDAKLVGLLANLPEKIKADFEISPFSITREYQAVAAAKGEQRLINEINNTLLRLEKEGKADEIYNRWFGPDTKSAQPRGDFKFAPLSEQAPQS

SEQ ID NO: 6930 - protein, 72 aa, Proteus mirabilis; identical to SEQ ID NO: 5832

SEQ ID NO: 6931 - protein, 146 aa, Proteus mirabilis
TAPFNTSFAAPNASSNEIPRPSTFSSLSFGIVINESTCLDNSVIPCSANAIRFLPSKLKGLVTTATVKIPNSFATSATTGAAPVPVPPPIPAAINTISAPSSAARNASRSSSAALRPTSGFAPAPKPFVMALPIWIVCPTAVLRNA

SEQ ID NO: 6932 - protein, 564 aa, Proteus mirabilis
GISSFMTSPRLELQFIRLWQAFEGKETETTLQELAETLHCTRRHVRSLLNKMHQTGWIDWQAEVGRGKKSTLTFHSNAFDIQQSRAERLLEENDIEKLVALMGDKDSLRQMVLSQIEKSFHPSQQRLRIIYYRPFRNLLPGTPLRRSELHLMSQIFNSLLHLKEENGEVEAELAHHWQMISEQHWRFYLRPAIYFHHGRELTIEDISTSLMRMKVCNPLYAHIEKITSPQPYVIDIYLTVPDKQFATLLGSPQAAILPQEWRTLANFSLHPVGTGAYQVMSNDQHKLQIKAFDRYFGLRALLDNIDIWVVPELKDKMVCSTLHLTDDDTHNNSLESRKEEGCYFLLYDSRSTQCQQPEIREWLSSVLTPVNMLAHCAPSYQRHWSPAYGLLLHWHHSKLIPPHTKPASLTKLTITLYKEHHEYSTIAELIKKILSDYDIELSIQVLDYEQWYYGDAKSDIWLATVNFYKPLEFSIFAALYELPLFHQCMGERYEDALALWRQKVLPLEEWCRQLTQNNWLFPLFHHLLELQGQRTIRGVKMNTFGWFDFKSAWFIPDLETPPLK

SEQ ID NO: 6933 - protein, 255 aa, Proteus mirabilis
LVPSRASFYKYCQNSHKALALLMREESNDRSLAMTSSFSSMMMAAVTSFLGDSVFTDAIAPFFSDYKAQFDKANKIIRHQYAGKFKRVIYLGSGGLQGLAQEAALKMLELTAGKVVANFDTPLGFRHGPKSIVNKETLVVMFFSNDPYTRQYETDLLREVIHDNASGKVIAITARNDKTFSPESFVYIPALENCSDVALLFPYLMLAQSFAFHSSIALGNTPDNPSPTGEINRVVQGVTIYPFSLKTEDTQSALN

SEQ ID NO: 6934 - protein, 444 aa, Proteus mirabilis
FANSISNTAGVDYGVSIYMHPLEKIVQQHKSGKQNGIYSVCSAHPLVIEAALLQALDDDSFLLIEATSNQVDQFGGYTGMTPADFYQYVIEKAENVGFPVEKLILGGDHLGPNRWQHLNAEEAMANADVLIAHYVAAGFKKIHLDCSMSCADDPIPLTDEIVASRAARLAVIAENTAKKTFGFSDIVYVVGTEVPVPGGAAEELDTVEVTSPDAARKTLACHRQAFYDAGVGECWTRVIGLVVQPGVEFDHTGIIDYQSEKAQALSQVVNDYSHLVFEAHSTDYQTNQAYQQLVHDHFAILKVGPALTFAMREGLYALCAIEETLFPLEKCSRLREKMEQLMCREPNFWQKYYHGDERQLAFARVYSFSDRIRYYWPDAEINTAIDTLMDNLSVKPIPLPLLSQYLPYQFTQFREGKIAGTPESFVIAKIRDVLSVYADACNVH

SEQ ID NO: 6935 - protein, 63 aa, Proteus mirabilis
YLLSISNVQAGEITFPKNFAVPCHQTLSDGIYLSNTAPLAYVEKILVKNNNIMIFLNIDFGLK

SEQ ID NO: 6936 - protein, 94 aa, Proteus mirabilis
LASSLAVLVLSPASAANRSNLSLNFFGLFSAKYFNDCALSTLKWRFFTGVGSFNDEVTLFFPAFMLKEGFILMSIEDNDGKISFLNAESNDGIS

SEQ ID NO: 6937 - protein, 98 aa, Proteus mirabilis
DSASNLTDAVLTVAGQLINLIVNLVAAAVTPALGNAVLDTLPKLTFRASDPAANSHALSIISPVKSIVPSAANALFATKIDVVAINIAIKLFLIYFSK

SEQ ID NO: 6938 - protein, 442 aa, Proteus mirabilis
LVASFTMKFPGKRKSKHYFPVSLRDPLLKPIINMTESESSRAYIVGIDQTLVDIEAKVDEAFINRYNLSQGHSLVIEDDVAEALYRELTVNNLITHEFAGGTIGNTLHNYSVLADDRSVLLGTMCNNIQIGSYAYRYLCNTSSRTDLNYLQGVDGAIGRCFTLITENGERTFAISPGQMNQLQPESIPEDVIADASALVLTAYLVRCKPGEPMPLATMKAIEYAKKHDVPVVLTLGTKYVIADDPQWWRDFLKEHVSVVAMNEDEALELTGHADPLLASDAALEWVDLVLCTAGPAGLYMAGFTESDFKRQTTHPLLPGAIAEFNRYEFSRAMRFKDCQTPEKVYSHIEPYMGGPEKIMNTNGAGDAALSALLHDITANSYHRINVPNSSKHPRSYLTYSSLAQVCKYANRVSYQVLSQHSPRLTRGLPEKEDSLEEAYWER

SEQ ID NO: 6939 - protein, 412 aa, Proteus mirabilis
IMASNQPALFHMMAKPTSYHCNIKCEYCFYLEKENIFQDETKETGHTVMPDGVLRRYIKDYIQSHSGDQVDFAWQGGEPTLAGLAFFEKVVKYQKQFANGKTITNSVQTNAIAINRQWAQFFADNHFLLGVSIDGIEAVHDKYRISVNGSPTFERVKRAINLLNEYGVEFNTLTVVNDQNWNKGKETYQALKNLGSTFFQFIPIVEVDRRFPHTHGGHYAPGPNAQLAAFSVPAEGYGKFMTDIFNEWIRQGDVGKIYIRLFDSLLGTWMGYPASTCIQSKTCGQALIIEANGDVYSCDHYVYPANNLGNIQLTSLAQLATSKTQQRFGQNKYDKQTNLCKQCEVQSLCYGGCPKHRIIAIEGEKYRHNYLCHSYKKIFHHTAIGMQLMRQAIARGGLASDALEAMQKNYLK

SEQ ID NO: 6940 - protein, 135 aa, Proteus mirabilis
NSASLSRNKITTIFKRGLRRMFEQVNIIYGEIVKKMTVMVGDFSQKEILFAKNTIGNLLAQRDVGKIYQLKVAKFKEKLAILTFKVNNSQQIEQFSDLIIKAKGIYRVYISSGSINRRNIVQKNSRFSYLNVAQG

SEQ ID NO: 6941 - protein, 178 aa, Proteus mirabilis
FVESKSMRDSYPQSLENILKELEGSNKSTLQLIQQRATILLKLNRTVMALLPAPLQGKCRVANYRNAILIIEVTNASWMTRLRYEIPSLLSALRKEILPSLSSIDIKINPSLSIKAGKKSVTSSLKDPTPVKKRHLSVESAQSLKYLAEKSPKKLRERLERLAALAGESTSTAKDDAN

SEQ ID NO: 6942 - protein, 225 aa, Proteus mirabilis
MSTPANFNGQRPVINPDDAVMLLIDHQSGLFQTVGDMPMTELRARAAVLAKMATLAKMPVITTASVPQGPNGPLIPEIHQNAPHAKYVARKGEINAWDNPEFVEAVKATGKKQLIIAGTITSVCMAFPAISAVAEGYQVFAVIDASGTYSKMAEEITLARIVQAGVVPMDTAAVASEMQKTWNRADAAEWAQAYTQIFPAYQLLIESYSKAQDVIKNNETLDSQR

SEQ ID NO: 6943 - protein, 904 aa, Proteus mirabilis
RVMLGKIVTKIFGSRNERAIRRMRKVVAQINQLEPEFEKLTDDELKAKTDEFRERLKKGEKEEDILPEAFATVREASKRVFGMRHFDVQLIGGMVLNDRCIAEMRTGEGKTLTATLPAYLNALSGKGVHVVTVNDYLAQRDAENNRPLFEFLGLSVGINLPNMAPPAKREAYNADITYGTNNEFGFDYLRDNMAFSPEERVQRKLHYALVDEVDSILIDEARTPLIISGPAEDSSELYIKMNKVIPHLVPQEKEDSDTFQGEGDYSVDEKTRQVNITERGLVKIEGLLAEAGMMKEGESLYSPANIMLMHHVTAALRAHALFTKDVDYIVKDGEVIIVDEHTGRTMQGRRWSDGLHQAVEAKEGVKIQNENQTLASITFQNYFRLYEKLAGMTGTADTEAFEFNSIYRLETIVIPTNRPMVRKDLPDLVYMNEKGKFAAIIEDIRERTKNGQPVLVGTISIEKSEEISQALTKANIHHNVLNAKFHAMEADIIANAGLPSAVTIATNMAGRGTDIVLGGSWQTEVAKLENPTEEQIEEIKAQWQKRHDAVLASGGLHIIGTERHESRRIDNQLRGRAGRQGDEGSSRFYLSMEDSLMRIFASDKVSGMMRKLGMNETEAIEHPWVTKAIANAQRKVENRNFDIRKQLLEYDDVANDQRRAIYTQRNELLDVADVSETIDSIRQDVFTSMIDNYIPPQSLEEMWDIEGLTACLQNDFDLNLPIKEWLDKEPELHEETLRERILEKSIEVYKAKEEIVSAEMMRNFEKGVMLQTLDSLWKEHLAAMDYLRQGIHLRGYAQKDPKQEYKRESFAMFANMLESLKYEVISTLSKVQVRLPEEVEELERRRREEAERLAKQQQLSHEVTKESQMSAVDGQVASGKKVGRNEPCPCGSGKKYKHCHGKLG

SEQ ID NO: 6944 - protein, 76 aa, Proteus mirabilis
RLYPQGMFLHVWLHRVLLVGLTLTYGMDTNTQIACNIQYSLFSLPPAQEVDPQNSFLVFLAFLFGQNTLDEVLEGA

SEQ ID NO: 6945 - protein, 407 aa, Proteus mirabilis
VCPFSAGAWLMSVYAMRRLKQWLVGSYQTDNSAFVPYDRTLLWFTFGLAVVGFVMVTSASMPVGQRLAEDPFLFAKRDGIYMIVALCLALVTMRVPMAVWQRYSSLMLFGSILLLLVVLAVGSSVNGASRWIAFGPLRIQPAELSKLALFCYLSSYLVRKVEEVRNNFWGFCKPMGVMLILAVLLLLQPDLGTVVVLFVTTLALLFLAGAKIWQFLAIIGTGIAAVVMLIIVEPYRVRRITSFLEPWEDPFGSGYQLTQSLMAFGRGDLLGQGLGNSVQKLEYLPEAHTDFIFSILAEELGYIGVVLVLLMVFFIAFRAMQIGRRALLLDQRFSGFLACSIGIWFTFQTLVNVGAAAGMLPTKGLTLPLISYGGSSLIIMSTAIVMLLRIDYESRLAQAQAFVRSPK

SEQ ID NO: 6946 - protein, 322 aa, Proteus mirabilis
AHQPPHSTSSLVVTIKIQVSRMRISKMVSDNSTALKTQDKPETGSLIDGIDEYQDTAVRKVITKGILWKCAFRGLFMEGNFNFERMQGGGFAFSIIPALKKIHGNNKRDYATSLKNHLQFFNASPKLFTFLLGTAVAMEENKEKPSTVNVMKVAGMGPTGGIGDAIDHMTLMPLTLALGASIAMEGSIAGPFVFFFLYQVVHFLVYFGLMFMGYRAGTAAMVNMSDATEKLAKAANIMGIFVIGALSATFIKVQTTASLELGGKVVELQTALFDKIMPNLLPLCLVFLMYKMVKSTGFWGKPPVLIFSTLAFGVIGHVLGFL

SEQ ID NO: 6947 - protein, 883 aa, Proteus mirabilis
STSTMVFAFIVKQKRIATMSTIDYPEKKASRSIRQQATMQSHILTRYYKFYRHNGASFSAAIVNELFWVLMWLFLRMESPFWQKIAQKQQQLFPHINPRRPKLCDPIRYLLQSIWLICHYLMLTLVKKPIQFIVYIRQYYQNLFARLSPVARDMIHHKKTNTPLWQYALLSLVAVFAIFIILLSITQPFDLKLQFVFVLVIWLIALAIRDIPRRLSSITIIILSLTIACRYIWWRYQYTLYWVDNLSLFFGILLLLAETYAWIVLFLSFMQCIWPLHRQPISMPQDTTQWPTVDIFIPTYNEALQVVKPTLYACLNIDWPKDKLTIYLLDDGSRPEFAAFAKEIGIRYITREKHDFAKAGNINHALSKACGEYVAIFDCDHIPTRSFLQFTMGWFLKDEKMALVQTPHHFFSPDPFERNLGNFRETPNEGTLFYGLVQDGNDTWNAAFFCGSCAVLRRCALDEIGGLAVETVTEDAHTSLRLHRHGWTSAYIRIPLAAGLATGSLSAHIGQRIRWAKGMIQIFRLDNPLFGKGLTLPQRFCYLNAMLHFLSGIPRMIFLLAPLTFLIFHAYIIYAPAIAIALYVVPYLLHIWLAATKLQGPYRHSFWGEIYETILAWYTTRPVLSTLFSPYKGKFNVTEKGAIMKKSFVDWQINRPYILFLNLNLLGILFAFWRIATGDPDERLAVLMCLVWVCYNLVLLGVAIAVSVEAKQERQFPRVRLKVPAILLLQDGSLYSCQLNDFSDNGCAIVLPDNFTVPLSCHQEITVILKQNQREYAFEARILRIDNRIIGLQLLNMDTQKSIDFTACTFERADTWANWQHALPADNPLNSLRNIIYISMRGYNTLLKRAPYLVYLLFRLLGQCLLWLLSLLPRRVNVSQIFH

SEQ ID NO: 6948 - protein, 79 aa, Proteus mirabilis
MAPTGFNIKTYYIDYKHLNFIQFCIMPPIMPPFYFVTHKLRNLDFSFSKTTCIAKISSIAFIVANNEIFYRAQLIFYAQ

SEQ ID NO: 6949 - protein, 107 aa, Proteus mirabilis
NGTTSQTVLPSRGALVKANFSANVGYRVLMTINLENKKPVPFGAQAIFKDNSQLNSIVGNDGEVYLSGLKQKGNFTIKYNNESCQVNYDLSDIPDYLGLYKTTVTCY

SEQ ID NO: 6950 - protein, 347 aa, Proteus mirabilis
QTEFTIFLYSFTFGYVNKTALRSLGMNDAKYGVLLVNLGTPDAPQPDAVKRYLAQFLSDPRVVDVSPWIWKPILHGVILPFRSPKVAKLYQQIWLPDGSPLLVYSRAQQKALAQRFAHIPVELGMCYGNPSLNEGLTRLLAQGVEKLIVLPLYPQYSCSTSGAVFDGISQLFKTMRTIPSLHFVRSYAQHPLYIKALANSIDESFKQHGKPDRLVLSFHGIPERFIKTGDIYFDECCLTVEKLKQQLDYPAEKVMMTFQSRFGREPWLSPYTDKTMEKLGSEGVEHVQVICPGFSSDCLETLEEINEQNREFFIHGGGKQYEYIPALNDKVEHIDLLEAIIRDICEK

SEQ ID NO: 6951 - protein, 488 aa, Proteus mirabilis
IVNTQQLAKLRSFVPEMRKVRHIHFVGIGGAGMGGIAEVLANEGYAISGSDLAPNVVTQQLVALGATIYFNHRPENIRDASVVVVSTAISADNPEIIAAREARIPVIRRAEMLAELMRYRHGVAIAGTHGKTTTTAMISNIYAQAGLDPTFVNGGLVKSAGTHARLGCSRYLIAEADESDASFLHLQPMVAVVTNIEADHMDTYHGNFDNLKETFITFLHNLPFYGRAVMCIDDDVIRSIIPKVGRYITTYGFSEDADVRITHYEQKGAQGFFTISREDMPDIDVVLNAPGRHNALNATAAVAVATEEGIADEHILAALLNFQGTGRRFDFLGNFSLEHVNGQEGEVMLVDDYGHHPTEVDATIKAARAGWPDKRLVMLFQPHRYTRTRDLYEDFATVLNQVDILLLTDVYAAGEAPIPGADSRSLCRTIRQRGKLDPIWVSDVENISSILAGVLTDNDLVLVQGAGNIGKIARRLAETKLQPSLSED

SEQ ID NO: 6952 - protein, 268 aa, Proteus mirabilis
IFWFRKETKVKAAVERRMEILDMVNQQGKTRVEDLAELFKVSSVTIRSDLSFLEKNGYIVRSHGAAIPNTGFIAELSIHEKRGQNAGIKTLIGKAAATLIKDGDTVILDSGTTTREIATHLKSRENVVVMTNGLDVAMELANTTGVEVLMTGGVLRKSALSFSGSQAENSLRNYRFDKVFLGVDGFDLRVGITTHNEQEASLNRLMCDISETIIAVADSTKFGKRSCHMIREFGDIDVLVTDSGIPDEYVQELKDHKIDVIIVDDKTA

SEQ ID NO: 6953 - protein, 402 aa, Proteus mirabilis
YRRFIRQRHDACYQQYLAFRASRNRKTQTPYNTRSGLIIMSKHYHIAVLPGDGIGPEVMAQAQKVIDAVNKRFSLNITTKEYDIGGIAIDNHGTPLPATTLAGCEQADAILFGSVGGPKWEHLPADQQPERGALLPLRKHFKLFCNLRPARLYTGLEAYCPLRADIAQRGFDILCVRELTGGIYFGQPKGRDGEGREERAFDTEVYHRYEIERIAHFAFKSAQKRRYKVTSIDKANVLQSSILWREVVTEVAKQYPDVTLQHMYIDNATMQLIKDPAQFDVLLCSNIFGDILSDECAMITGSMGMLPSASVNEAHFGLYEPAGGSAPDIAGKNIANPIAQILSTALLLRYSFNEDKAAQAIEEAITRVLATGYRTADLAGEGNAITTAEMGDHIAQFIQEGA

SEQ ID NO: 6954 - protein, 345 aa, Proteus mirabilis
VNNTELVDISTFEEFESYVNQAIADPEFSLDITNLKFSIFDAFKMKIEGDDSKYYGGVNTTLAQGMSDFQVELNKIFAIIRYNTDNLQRLSSQDKKDLELTFLVNAGCTEILTSLTEFVKSIGDAGAKVMNGMTPNQKTLCVLFTVAVIGGGWGISNYANNVHDENMAQIQSQQSASERQSELDRLQLLKDGMLDAINATSNTELKEKSVGIENHGAKAYTDIIKSASDADNITISGLTNISLDQQGIQNVIKNPIEKLENKEDTIEVEIESIKRNADSLSVACRIPGMDYVFSISVNTGFIDRDETDLLFDAMKESKTVKILGNYKTRGGVIEKGNASSIIISN

SEQ ID NO: 6955 - protein, 186 aa, Proteus mirabilis
NLRFLMNKSKYFILPIFLYLLSGTARAVDINIAITGAIYVPPCVVNNNIPIQFSFNQIMTYKVDGQTSAITKNIPITCTYFKGSPYVKVSGIQLAGAPDNVLKVSADSVNSNRFGLALYQGESVDENNPLRLNGSAPRGYAITKGFSNTGQDRSQFTITAVPFKTGTADLSPGNFTASASLSIVYN

SEQ ID NO: 6956 - protein, 349 aa, Proteus mirabilis
AKITAIDSIKNTHYCTVIGIHHTKIDYFYHTHYVTFTSFTIRKKNMLDQEMIRTFIQVADCQSFTKAAEMLHKTSAAISYRIKTLEENIGTQLFNRTTRTVTLTPAGEYLLEKCRQWIVWLESMPIELQQMNAGVEHQVNIVINNLLYDRTAVASMLACLHQRFPSTQFHITRQVYMGVWDALINEDYHFAIGVTGNESLKNNINICAMGEIQWQFVVAPNHPLANVSGVLSDDQMRIYSAVNVEDTSRHLSKRTAWRLSGQHEIKVPDLHTKLACHLKGVGIGFLPLSLCKPLIDSGQLIAKEVKNRRHNSPLSLAWCEDKKGAVVSYLVDLFRQGHPSVQSFYDPLN

SEQ ID NO: 6957 - protein, 323 aa, Proteus mirabilis
TNSTYLCHPLIFGSFCLNEVVMNETQLTHLQQLEAESIYILREVVAEFENPVMLYSIGKDSSVMLHLARKAFYPAKLPFPLLHVDTGWKFREMYEFRDKTAKEYGFDLKVYRNPQGAQLGINPFIHGSAKHTDIMKTEGLKQALDKYGFDAAFGGARRDEEKSRAKERIYSFRDRSHRWDPKNQRPELWQNYNGQINKGESIRVFPLSNWTELDIWQYIYLENIDIVPLYFAKHRPVIERDGTLIMVDDDRIDLKAGEVITQQKVRFRTLGCWPLTGAIPSQADTLPAIIEEMLISTSSERQGRLIDSDQSASMELKKRQGYF

SEQ ID NO: 6958 - protein, 874 aa, Proteus mirabilis
SLTTNTHKRDKLQYVKKDDTMTDSQNFESHTPMMQQYLKLKAEHPEILLFYRMGDFYELFFDDAKKASRLLDISLTKRGQSAGQPIPMAGVPHHAVENYLAKLVQLGESVAICEQIGDPATSKGPVERKVIRIVTPGTVTDEALLEERQDNLLAAIWQDKNGAFGYATLDITSGRFRVTEMPDSESMAAELQRTHPAELLYPETFESMALIERQQGLRRRPIWEFECETAKQQLNLQFGTRDLTGFGVENARLALCAAGCLLQYVKDTQRTALPHIRSITMERPQDTIILDAATRRNLELTQNLAGGCDNTLASVLDLCVTPMGSRMLKRWIHTPLRQREQLIKRQDAISALQPLYFELQPFLRQVGDLERVLARLALRSARPRDLSRMRHAFQQYQDIHQVLDQADMPYIKELQQRISQFDELRELLENAIVETPPVLVRDGGVIAPGYNAELDEWRALADGASDYLEKLEVREREKWGIDTLKVGFNGVHGYYIQVSRGQSNLVPMHYVRRQTLKNAERYIIPELKEYEDKVLTSKGKALAIEKMLYEELFEKLLPHLTALQTSAEALAETDVLANLAERAESLNYTRPELTEKTGIQITGGRHPVVEQVLSEPFISNPLQLAPQRRLLIITGPNMGGKSTYMRQAALITLLAYIGSFVPAEKAVIGPIDRIFTRVGASDDLASGRSTFMVEMTETANILHNATENSLVLMDEIGRGTSTYDGLSLAWACAENLANRIKAMTLFATHYFELTTLPEKLEGTANIHLDAVEHGETIAFMHSVQEGAASKSYGLAVAALAGVPKEVIRRAKQKLKELETLSGHSGASHVETSQLMLLADIEPSEVELALNKIDPDSLTPKQALELLYHLKELNK

SEQ ID NO: 6959 - protein, 316 aa, Proteus mirabilis
IMTTNNFSHTSVLLDEAVNGLNIKPSGIYIDGTFGRGGHSRLILSQLGEQGRLIAIDRDPQAIAVANEIDDPRFSIIHGPFSNIEQYINELGLSGKVDGVLLDLGVSSPQLDDPERGFSFMRDGPLDMRMDPTTGQSAAQWLMNAEEDDITWVLKTFGEERFAKRIARAIVARNKTEEPLTRTKQLADLISEASPVKERHKHPATRSFQAIRIYINSELDEIEKALKGAVSILAPAGRLSVISFHSLEDRLVKRFIRDESKGPVVPAGIPLTEEQIKALGSARLSSIHKMKPTGVEVEENPRARSSVLRVAQRIEE

SEQ ID NO: 6960 - protein, 78 aa, Proteus mirabilis
GLKTQKPICRQKILFIYKWVLCSKPGTITIPTFTRTLTWDIYIVKLSTVKLVIDHIFIRLIKKRLFKVRTIPADGFIF

SEQ ID NO: 6961 - protein, 247 aa, Proteus mirabilis
MRKTMPLIVLKGLRGGVGTTSITVALARQFHHHKYNVIVIDNCVNNILHFYFPEKSQVTTLGQALLAHTPIEQAICDYQNGYQILPFGVVNSEDKLHLQASATANQHLQHFFTAFTQQYPDTLIFLDLQPEHDTLFKSWVAKANIVLTVTTPESNCHIRLNQHTFAANEYILVNQFCATSQIHQDFYQFWQTSQFPFCPIKLHRDEALLEACASRLPLYDYRANCMLVEEINQLLQWCLPLLLSKKG

SEQ ID NO: 6962 - protein, 71 aa, Proteus mirabilis
SMETFQLDGHPYVELCDLLKLQGWTESGAAAKNIIAEGLVCVDGEVETRKRCKITAGKVVTLGEFAVTVSN

SEQ ID NO: 6963 - protein, 167 aa, Proteus mirabilis
LRETMEYLSYQTAELEQLNAFWTAKEIDQQPECWKKTWLSIREKRADIESFLEKALEASNSRIILTGAGTSAFAGRALAPILTGAIKRRVDAIATTDLVADPQEYLAEDIPTLLISFARSGNSPESVAALDIAKKCLSQCYPLVFNLYPPGPAFINIAKIVIRHWRY

SEQ ID NO: 6964 - protein, 156 aa, Proteus mirabilis
RLMTRPILTLKKKSMAAEPLAREATKSARTKRSQEASKQSKKKNKADAHAKKKQYRIDRIAKHWTIFNEPEAKPLMIGIKEVMIAEVKDKGLDIPESHIKQGLRSYISRKTYLKALTLGGNRFDMNGRPKGEITPQQQALAKQMLVEWAKKKQQHK

SEQ ID NO: 6965 - protein, 339 aa, Proteus mirabilis
MNKTLIGIALFSLATPYAVGWQQNFLHVPSNGSTASATAPALNVTDANASGVIKVTIPQVKGWRVIASYCSGSGSMAEEGNYRYWIRLPQTNTWQKHSSGLSYYLSNLSWTLAGTNNNNNQVYVGPNYYAKQSPSGCHSVGTVWGLGSAVLPLDRSMSLTVAVSRATAYPGSYNLNIPFAWAYEENKGSGGNSTGYLQFGNAMKPYMNSYINIPVSITSKCNIKNQVINLSHGNMTPEESINNVTPPYNYQLTCDYDASVSVSLIGSAPVSGKTENYTKCGNSGSCELKYNDTEYKGKFKLNAGAAKTFSITSTFHPNDIRNPVEGSFQGSAILRVLVD

SEQ ID NO: 6966 - protein, 568 aa, Proteus mirabilis
ATYFYTLYFYKDFLMNYNKLFLISFSLIYSANVFSNTDSPLPTDNPSQLGNGSMVESNIGIPSTSTTHLPQPPLMGNRAPVISPSPLPTDNPSQLGNGSMVESSVDIPPTSTTHLPQPPLMPHLPQPPLMRDRAPTIGNTSGYMSRFPYTFINPITRYEMPYIGQKSINNIHKDDYITTKAYFDMSDSSMGYYNYIIGQYIESYLNISNPSTPSENIVVRLAQPFFDHMRKSLSEAIHVDSNEVGSMLRDIDKNKKDIARALFSYLENVKNDLERTMNNGDTSEPELAKIALLDKIKKFKNIVDENIKNGTSFIIVENQETAEPLTEIEKIIGRLSQPATQGEVANAYISLSRVIEDEVRMIANQQKITANTLTSQDNKITKVESDVKKNEGNIAVNREGITKVESDVEKNKEDIQTNRENINQVKQTADKNKIYVDKYLANNFDVNEQSKSLVGHLGSLYAGNKSNTDNINAIKNDLSHFKNETNNRFYKVEKRANQGIASVAAMSNLPFNDAATFSTAMGIGNYRNATAFAWGMQYRINENVKVKASTAWNDANNWVSAGGIGISW

SEQ ID NO: 6967 - protein, 81 aa, Proteus mirabilis
ICDAGLSPTKITAKPGARFPILIRCFTFSATSLLMVRAIVFPSIILADIYTSKLFNYGIALFCQIISNLSVDYLPYFNHLV

SEQ ID NO: 6968 - protein, 177 aa, Proteus mirabilis
KRDALIVDTVNRNTLLTCYKRVVELSATRKELLMIGLIVSGHLNFATGMASAVKAIAGEQENIAFIDFIESISPDELEQKMREAINAMSCQQYLFLTDLPGGTPCNRAMAIMMQNPSVEVLAGVNLPMIVNAAFEREGCSTTELVQTLREIGQDSIQDIREQLAQIDSHDVEEEDGL

SEQ ID NO: 6969 - protein, 63 aa, Proteus mirabilis
HILFPDGERGKSHIMCMVKIIYFCVMDTYHSAIVGIFYAVNRCYFGLFVIICCIKFLLFIDKR

SEQ ID NO: 6970 - protein, 72 aa, Proteus mirabilis
TSLAATHSGYGRLSLMRTFLIAGYGTTLKGLTLGINKQVISASLKDAQSQVVREAQRDGLIDIRINYVREVK

SEQ ID NO: 6971 - protein, 223 aa, Proteus mirabilis
DGYAFYAESSQPLSVCSRKRNHKVGGGDEMRQVTINATSLSPFMYQGKRVVTFAMIDEVHQRPKGTAKRTFNTHKKHFIDGVDYFLLTKYVIRTELPELEIAGKAKELMLITESGYLMIAKPFTDDLSWQVQRSMVNSYFRLSDFPEIKHIQIPSLTELEAMPIGEAQNLISRLEADSYQGHGRRGSYAMNLRRKEKKALKPMVIAIEQASQLHIQDMGDYRS

SEQ ID NO: 6972 - protein, 120 aa, Proteus mirabilis
YICALLWRRWESCGMISPFILGVVMGKLTVLLLILLGFLQYSLWLGKNGIHDYNKVSQEVESALAQNAQLKSRNDRLFAEIDDLNGGQEALDERARSELGMIKPNESFYRIVNDKSQPRR

SEQ ID NO: 6973 - protein, 62 aa, Proteus mirabilis
INLANQLFYLNNNKSYLHLLLIINLLSHFNNLLCSAPGAWINLVQALCQYQKEKSPGKYTVY

SEQ ID NO: 6974 - protein, 62 aa, Proteus mirabilis
KALASSNLLSNTKRLQFFENISFISADYDKLQKSSNKKWSDLSGSYANSPAIRGTKRTASID

SEQ ID NO: 6975 - protein, 603 aa, Proteus mirabilis
IIKASMKFSRSAKAKTKTKSNAKLRKPEEKTGFVSWRFALLCGGIGIALAALLIRVAYLQIINPDPLIREGDLRSLRVQKVPTARGMISDRMGRPLAVSVPVYAIWADPKVVLEANPDMTDSRWLALADALKLPVNQISQKISATPSARFIYLARQVNPEISDYISKLKIKGINMRQESKRYYPSGEVTAHIIGVTNIDGDGIEGVEKSFNQWLTGAPGERVVRKDGFNRVIENIAQTDSQAAHNLMLSIDERLQSVVYRELTNAVIENKAESGTAVLVDVNTGEVLAMANSPSYNPNNLAGTPKDAMRNRAITDIFEPGSTVKPMVVMSALNNNIIKENTVINTVPYRISGHQIKDVALYRELSITGILQKSSNVGVSRLALAMPASELVDVYSRFGLGKPTNLGLVGESSGIFPIKKQRWSDLERATFSFGYGLMVTPLQLARVYATIGSFGIYRPLSITKVDPPVPGTRVFPEKVMRTVVHMMESVALPGGGGVRAAIKGYRVAIKTGTAKKVGPDGKYINAYISYAAGVAPASRPRFALVVIINEPKAGKYYGGAVSAPVFGTIMGAVLRTMNVEPDALTPDDKSEIVINKKEDTSGRS

SEQ ID NO: 6976 - protein, 340 aa, Proteus mirabilis
LEEAKVKLDEIARLAGVSRTTASYVINGKAKQYRVSDKTVEKVMAVVREHNYHPNAVAAGLRAGRTRSIGLVIPDLENTSYTRIANYLERQARQRGYQLLIACSEDQPDNEIRCVEHLLQRQVDAIIVSTALPPEHPFYQRWANRSLPIIALDRALESEHFISVVGDDLEDAKMLASELKAFPSQSVLYLGALPELSVSFLREQGFRSVWQDDPRQVTYLYANSYEREAAAEVFSEWLNNNPMPDALFTTSFALLQGVMDVTLQRSGRLPTQLVIATFGDHELLDFLECPVLSVAQRHRDIAQRVLELVLASLEEEQKPQAGITRIRRDLCRRGSLGRTR

SEQ ID NO: 6977 - protein, 569 aa, Proteus mirabilis
LVEALPVMHLRRCKKTISSDSYFISFYLFWRQSVTLPFVKKSILAGIIATSCLSLPISAHAGGTPEKPNVLLIVMDDLGTGQLDFVLDTLDVDALAQRPTPPRYKGDINKMIEAARIAMPNVSDMAENGAKMTNAFVAHPVCGPSRAGIFTGRSPASFGTYSNDDAILGIPQDIKLLPSLFQENGYATASIGKWHNAKVIRKPKINENKQTRDYHDNMISTPEAGYAPHERGFDYAFSYYASGVALWNSPAFWRNGVNVPAPGYTTHLLTDETLKFIDEHKDKPFFINLSYSVPHIPLEQASPAKYMDKFDTGNVEADKYFAALNAADEGIGQIIAKLKENGELENTLIFFLSDNGAVNESPMPMNAMDRGFKGQMFNGGVRVPFIAYQPGTIPAGTKSDAMISALDILPTALQVADIQIPDSLQVEGKNIMPLLKGETTRSPHAYLYWAGPGTKHYSEENQEFWHGYHQWITYQRQTPPVNPNLEKLSKGAWAVRDGEWALYFYDDGKNQPQLFNDNTDPGESIDLAKQNPQKVAELKNAYYQWIKDKPKPVIWGQDHYQILVDSAKP

SEQ ID NO: 6978 - protein, 320 aa, Proteus mirabilis
YSFYLLKQAKDRYMEIVIGIIILFAIILVLSGVKTVPQGYQWTVERFGRYTRTLAPGLQLLIPFIDRIGRRINMMEQVLDIPSQEVISRDNANVSIDAVCFIQVIDPVKAAYEVNNLELAIINLTLTNIRTVLGSMELDEILSQRDQINSRLLLIVDDATNPWGIKITRIEIRDVRPPQELISAMNAQMKAERTKRADILEAEGIRQAAILKAEGEKQGQILKAEGERQSAFLQAEARERAAEAEAKATQMVSEAIAKGDMQAINYFIAQKYTDALSQIGSADNSKVVMMPLEASNLMGAIGGISELLNTKKSDSGNKSN

SEQ ID NO: 6979 - protein, 97 aa, Proteus mirabilis
KSYYHGVFYHSGVNIISSINALFDQRIFRQINNVGIMLIFSSILEMGIDAYFNSVLFFQTRYLYNSNCLKNNALPIIKINYLLSTAIPLFNNYKSIG

SEQ ID NO: 6980 - protein, 64 aa, Proteus mirabilis
IRHYSLKRFSLIIKYEALFLIFMLYLILNLIGVLMFNLPIQGVSLLFLQQKSDTYDFTTGKVQA

SEQ ID NO: 6981 - protein, 290 aa, Proteus mirabilis
PFRYAPISKNEVFIMEIRQPIHSEHAKRLDTEGLRKEFLIENLFCEGEMNLTYSHIDRIIVGGVVPTTQPLALMAGKALGVDFFLERRELGAINIGGAGKVIIDGEVFEIGPREAIYIGMGAKSVEFTSDSVETPARFYINCAPAHHTYPTRKITQQQASPEKLGNAENCNVRTIYKFLHPSVLPTCQLSMGMTVLEPGSLWNTMPCHTHERRMEVYLYFDMKDDNVVFHYMGEPTETRHLVVRNEQAVISPSWSIHSGVGSASYTFIWGMVGENQVFHDMDHVAMKDLK

SEQ ID NO: 6982 - protein, 286 aa, Proteus mirabilis
KFILFLHLKCFPSLSNRKIGSLFFSVFSHVSYPKQSMYLIIKPLTVRQLSVIIISIHWISEFLMQYPINEVFQTLQGEGVFTGVPALFVRLQGCPVGCSWCDTKHTWEKEESKKVPLGDIPIKTQESDTWGIATVEDILSLFRQQRYSAKHVVITGGEPCLYDLRPLTEGLEKAGFDCQIETSGTHDILCSEATWVTLSPKVGMRGGLSVLSSAINRANEIKHPVAREKDIEALDDLLRLRTQQPMAIVALQPISCKESATALCIKTCIERNWRFSMQTHKYLNIA

SEQ ID NO: 6983 - protein, 108 aa, Proteus mirabilis
AMRYIPSTVKSESYSKLSSLISRNYPELFEVAQLNYKYEIMIQSVFIFFYLPHHHQATFELMIYGIWLVGLKQGEEIHASFLVAIMPYASVLTICKHQFLVLNLYHSF

SEQ ID NO: 6984 - protein, 437 aa, Proteus mirabilis
MHLLNEVVMFVAALIFVLTITLVIWQPKGLGIGCSATAGAILALLFGVISFQDIPTVWNIVWNATATFVAVIIISLLLDESGFFEWAALHVAKWGGGKGRLLFSYIVLLGAMVAALFANDGAALILTPIVIAMLLALGFNKGTTLAFVMAAGFIADTASLPLIVSNLVNIVSADFFNIGFTEYASIMVPVDIAGIVATLVMLHWFFRKDIPNQYDVKKLSEPALAIKDMTTFKAGWLVLLLLLIGFFILEPLGIPVSAIAAIGALILWVIAAKGRTINTKKVLRGAPWQIVIFSLGMYLVVYGLRNAGLTDYLSEILNYLADKGLWIATIGTGFITAFLSSIMNNMPTVLIGALSIEGSDATGVIQQAMIYANVIGADLGPKITPIGSLATLLWLHVLSQKNMTITWGYYFKTGIIMTIPVLIVTLVALVLRLSLFN

SEQ ID NO: 6985 - protein, 207 aa, Proteus mirabilis
LNLYYPVNNNIMERTMFKKALLSLTAGALLFNASSALAADYQIDKQGQHAFVQFRIQHLGYSWLYGTFKDFDGSFTYDKEDPSKDKVDVVIKTGSLDTNHAERDKHLRSADFFNVSKYPEAKFVSTKVTRDGENYTVTGDLTLNGVTKPISLNAKLIGEGTDPWKGYRAGFEATGKVNLKEFNFKSDLGPKSQEAELIISVEGVKKN

SEQ ID NO: 6986 - protein, 302 aa, Proteus mirabilis
AMKYDLNDLYYFVKVVEFGGFSQAAETLGIPKSKLSRRIADLEERLKVSLIYRSTRQFHVTKIGQTFYQQCKNVVEQAEIAQEVICSAQGHPHGTIKLSCPVALLQIYIQDILVDFMAKYPDINIQILAINRPVDVINEGLDLALRVRALPLDDSGLTMKILGYSRRVLVANPLLFATNSAPDSPEQLADYPILANSEHSQQYTLTLTHNDGTVSTQHVTPKLATTDVMTLYKATLKGLGITRLPLSVVEKELTDGSLVEVLPQWRFPKDVIHAVYPSRKGLLPAIQVLLDYLAQNMAPYKE

SEQ ID NO: 6987 - protein, 648 aa, Proteus mirabilis
QARYKLILPKENVMNDNIARKMQQTYNITYWGGGYYCANNRGNISVCPNPDVPEATLDLTELVKQVQEEHSHLRLPALFCFPQILQHRLRSINAAFHRARESYGYKGDYFLVYPIKVNQQRRVIESLINAGEPLGLEAGSKAELMAVLAHANMTSSVIVCNGYKDREYIRLALTGEKLGHKVFLVIEKMSEIKMVLEEAERLEVIPRLGVRARLASQGSGKWQASGGEKSKFGLAATQVLQLIDTLRQAGRLDSLQLLHFHLGSQMANIRDIATGVRESARFYVELHKLGVNIQYFDVGGGLGVDYEGTRSQSDCSVNYGLNEYANNVIWAIGDACDENELPHPTVITESGRALTAHHTVLISNVIGVERNEFTAITPPDEDAPRPIASLWETWEEMQTKGNSRSLREWLHDSQLDLHDVHTQYVHGMLSLTERAWAEELYLNICRHIQYDLDPSNRAHRPIIDELQERMSDKFYVNFSLFQSLPDAWGIDQLFPVLPIEGLDKPLDRRAVLLDITCDSDGIIDHYVDGDGVETTMPMPAYDPEYPPMIGFFMVGAYQEILGNMHNLFGDTAAVDVYLDEKGNLTYQLSEEGDTVADMLQYVKLNPAVLLERFRTQVKNAQLDKALQEQFLTEFESGLYGYTYLEEEE

SEQ ID NO: 6988 - protein, 467 aa, Proteus mirabilis
RMDFITNILSAINGVVWGVPMLVGILGIGLFMQFRLSFLPIRKLGTGFKLLFEKNDKRGEGQISPFNALMTALSATIGTGNIAGVATAVVLGGPGALFWMWMTALVGMATKYSEAVLAVRFREVDKYGNYVGGPMYYIKNGLGKKWLWLGTLFAIFGSFAGFGIGNTVQANSVADVLQSNFGISTTVTAIALVILVGAVLIGGIKRIADVAGKLVPIMTVGYFGAGIVVLALNITAIPDAFMLIVKSAFTPVAAQGGFAGAAVWAAIRFGVARGVFSNEAGLGSAPIAHATAKTQNPIRQGLIAMLGTFIDTIIVCSVTGLTIVITGQWLTGQSGATLTASSFSMAIPGGNYIVAIALAVFAFTTILGWSYYGEKCVQYLFGPKAIMPFRIAWLIALPIGATQSLEFVWLLADTLNAMMAIPNLIALALLSPIVYRLTKDYIKDVNAVDIDLNEQVNSVSKKEAEAE

SEQ ID NO: 6989 - protein, 467 aa, Proteus mirabilis
IMYQRNTIKKSQNQQRFNWFRKAKETNLAPVKTLILSAIIGTLAGLIGVLFEKAVGWVIHLRQDKLAEALTNPYLLAIGTLLVSSLLAMSGYYLVKKFSPESGGSGIPEIEGAMIDIRPVRWWRVLPVKFIASIGTLGSGMVLGREGPTVQLGANIGQLVNDVSRVKDKGTRQTLLATGAAAGLTAAFNAPLAGILFIIEEMRPQFKYNLISIKSVFIGVIMSCIVFRLINGEGGVIQIGKFSSAPMNTLWLYLVLGMLFGVVGVIFSKLLFYVQTQFQHFYQDKTSRFVLAGGVIGGACGLLALIIPEITGGGFSIIPALSAGGYSLTALLLFFVLRTITTIISFSSGAPGGIFAPTLALGTLFGSAFGLMATYLFPDYQIQIGTFAIAGMGALFAATVRAPLTGIVLVLEMTDNYQLILPMIITCLGATMLAQLLGGRPIYTVLLERILQRSEAKEKTEAPKEPL

SEQ ID NO: 6990 - protein, 273 aa, Proteus mirabilis
GAYQMKDIIQKIKKWIGIQKTSYYPYPAIDISLPNHVSLHLVGSIHMGVPTMSPLSNVLINKIATADAVIVEADISTETQPFDQLSLLREPLEQRVNETQLATIISHCDLLSIPHYQIDDKPLWQIALILQSTQAMQLGLQPQHGIDYQVIQQANKQQKAIIELEGIERQVALLLDFPQDGAQLLEDTLKNWHENARALQIMINWWLNYTSEKHPSPLPNTFSKAVFDILMEKRNQVWATTLSNLPAGHYVVTVGALHLFGEDNLVDRLTYQA

SEQ ID NO: 6991 - protein, 295 aa, Proteus mirabilis
MQNQVAQSMKNSIKVYLVNSFTRDHCGGNPAGVVLNPPKLTTEQKIAIAQQVGFSETAFVYSGDDTDFKVDFFTAEGEVDFCGHATLAVFFTLSSLKLLKPGDYSQKTKAGILTVTINHDNIVMEQTLPITRKGPCVNDVAKALGILPEVIEKTDLPIEIVSTGLNDIFVPVQFGYLDALQPDYQAIAALSHKFDTIGFHVFELSHDQNITAHCRNFAPRYGINEESATGSSSGALGCYLVHHLLPNKRQFLFEQGRAMQCSSLIDVFIDSTAKNVTRVQVGGKATLIGTKIIEI

SEQ ID NO: 6992 - protein, 78 aa, Proteus mirabilis
KLNHSVNRRIADPVSLLGKWLIRLSHVWSEWVMIHCLLVILFKNQNSTRQYYTRSMSRVISSLSSFSLERSCLLLANR

SEQ ID NO: 6993 - protein, 121 aa, Proteus mirabilis
RWDHLRAILNLLLFIIKCVIKGFQVNRSYPASKMVGKKIAYYRRVNGLTLSELAKKIGISQQQQSRYERGINRVSLDRLYQYACFFGISLSDLFQLDDEEKVEIENKISNMVGNKNEPFDG

SEQ ID NO: 6994 - protein, 92 aa, Proteus mirabilis
ICCLILIICYALRRVLGSIWFKHCANTRKRKAPENILYINRGGLKNTQFDSASIFIGTQEEMKKSTFILANILVRNKLKGIGIKLPIINIKS

SEQ ID NO: 6995 - protein, 97 aa, Proteus mirabilis
ICCLILIICYALRRVLGSIWFKHYANTRKRKAPENIQYINRGGLKHRQFDSASILIGAQEEMKKYSLIGLIMVAMITPSNLLLEQKPVVYSPLIRSI

SEQ ID NO: 6996 - protein, 96 aa, Proteus mirabilis
HKHQKIIHLYIKENKLTFKLHINEMIIPIYITTCFTLCLANNKTKYDKNHNKIIKSITLQDTFRTITVTTVIIFILIFKMLLKFIDIVVNYNRSSP

SEQ ID NO: 6997 - protein, 301 aa, Proteus mirabilis
RNKQHLYLKLSKRDKLMLATAHIVDVNESNIQQVIEQSMTKPVMMYFYSERSPHCAELGATLDKLAAEFADQFVLAKLDCDVEQMIASQFGLRAIPTVYILQEGRPVDGFQGPQPEEAIRQILANILPKPEELKAAQASALLAEGKADEALPLLKEAHQIDPKNSEITLALAGALISLNKHNEAEELLAAIPLQDQDSYYHSLLAQIELQKQAADTPEIQQLQDNFNQQPDNTELAIQLALKLHEVARNDEALELLFNFLKKDLNAGEGQVKKTLMDILSALGTNDNLASKYRRMVYSLLY

SEQ ID NO: 6998 - protein, 144 aa, Proteus mirabilis
TFPQGEGQGGILNISEIATKTGLTTKAIRFYEEKDLITPPHRGENGYRYYLPQHIEELTLLKQAREVGFSLEECRSLLMLLRNPSRHSADVKEATLKKVAEIEKTINELNAIRQRLLLLANECPGDDGAECPIINHLSGCCHHQ

SEQ ID NO: 6999 - protein, 64 aa, Proteus mirabilis
AIPQERLNGIEDKIALHVFFVRHLGQLSIVLNVASSHYPDFISYSVSYMSPLLAITFRVKKRVV

SEQ ID NO: 7000 - protein, 216 aa, Proteus mirabilis
NWEQHMESIIHLITFEDDSTKVQLKAVLSSLAANVKTYSNEQAFLKYYFSSTKGAHKECIIINTKSSASPSIALVKELNKLKNIIPVIIISGDASIESCRNAFKAGAFEYLTRPLNVNELLNIVSESFLHYESEVEQFRTYISLKDKFSKLSNREKEVMEMILDGNTSKEAAEKLSLSPRTVEVHRSNMYTKLKIRSLPQLVQEYDFFKKYDLRAN

SEQ ID NO: 7001 - protein, 278 aa, Proteus mirabilis
QIINYILFFIPTKKSVAIIATLLEVLIMNLFDLTGKVAIVTGCNTGLGQGMAIGLAQAGADIVGVGIQDAPETRQKVEALGRRFHYITQNLIQQDGLDALVDEAVKVMGRIDILVNNAGIIRREDLLQFSEKDWDDVININQKTLFFLSQKVARQFVKQGEGGKIINIASMLSYQGGIRVPSYTASKSAVMGLTRALATELSQYNINVNAIAPGYMATDNTAALRADEARNAAILERIPAGRWGTPEDVAGPAIFLASKASDYINGYTIAVDGGWLAR

SEQ ID NO: 7002 - protein, 440 aa, Proteus mirabilis
RYVNMANYQGKKVVIVGLGITGLSCVDFFIRQGVTPKVIDTRQHPAGLDKLPADVEYHTGSFHQVWLNDADLIVSSPGIALSTPELVEARDHGVEIVGDIELFCREAKAPIVAITGSNGKSTVTTLVGEMAKADGIPVGVGGNIGVPALTLLTQPYDLYVLELSSFQLETTYSLTAAAATVLNISEDHMNRYPLGLEQYREAKLRIYDNAKTCVYNADDVLTLPLAGKDARCVSFGIGQGDYQLDNTNRYLNVNGENILATSQMFLSGQHNYTNALAALALADAVGISRKASLAVLNTYHGLAHRFQLVYSHNGVRWINDSKATNVGSTEAALRGLEVEGTLHLLLGGDGKSADFSALLPYLSGDNIRLYCFGQDGQALANLRPQVSQLTATMEEAMRLLAPTVQTGDMVLLSPACASLDQFKSFEQRGDEFARLAQELG

SEQ ID NO: 7003 - protein, 93 aa, Proteus mirabilis
PLVKHILINIIIYTHLLAFSPEGFLFAVSNKKPYALFLISNINCSHTVIRLDGHLALDKQTRLFRFCFFFAYRIHLFIEININRINIFYIVFC

SEQ ID NO: 7004 - protein, 298 aa, Proteus mirabilis
LLTKNIQFDLKKHYNCSRIFIEGTMSTATNLNELQEQVRSRYNGLSKRLQQVAHYLLDNKNSVAFDTIAILADKANVPPSTLIRFANAFHFKGFNEMKLLFQRHLMGEMDNEKLTYKQQYKKEPPNLNEPDYILQEFAQANSHALQQLAHQTHKDMLNKTIQLLEYAETIYIGGFHHSFSAASYFFHALSHIPCETVFVNCLGGMYKEQLRNITHRDVLFGIHFHPYSEEMQKMCEIAAYKEAKQIIVTDSPISPLASLSDVCLTVKEAQIKMFRSQTSTLCLLQALSVAFAFRKKSH

SEQ ID NO: 7005 - protein, 164 aa, Proteus mirabilis
GTHNMRIGHGYDVHKFGGEGPIIIGGVRIPYEQGLLAHSDGDVVLHAVTDAILGAVAMGDIGTLFPDTDPAYKGADSRVLLREAFSRVMAKGYRIGNLDVTIIAQAPKMLPHTPQMRVNIAEDLHCHVDDINVKATTTEKLGFVGRKEGIACEAVVLLIKESLS

SEQ ID NO: 7006 - protein, 493 aa, Proteus mirabilis
NQDNEMKQRLEQSTTALNALQKKRGEQFYPQFHLAAPAGWLNDPNGLVYHNGLYHAFYQHHPFSELWGPMHWGHATSKDMIHWQHQPIALAPGNEYDKSGCFSGSAVSHEGKLYLFYTGHNWLAEEGDDSQIYQAQCVAVSEDGIHFEKKGIILPPPQGYMHFRDPKVWFQEGKWWMVVGARDEKDQGQVLLFSNDTLFEEGKQWRSVYKVLGKTDDKNVYMWECPDFFPISDDNEFALVFSPQGKRAEGYQYRNLFQTGALIGQWSPKQPFIIHGHFTELDNGHDYYAPQSFVTADGRRVSMGWMDMWNSPMPSQQEFWAGCFTLPREINFDKRANRLRMTPIKEVESLRQTRNTIEMTTLNNQALKLLDKTPAIELNLTWSLDSQAEKFGLWLGKGLEVFVDNQSNRFVIRRHYPQYNISGSRSTPLPVGSEINLRIFIDRSSIEVFINHGELTFSSRYYADENDRDLSLFATDGSATLIAGEYWTLSTIS

SEQ ID NO: 7007 - protein, 126 aa, Proteus mirabilis
RHRNHSLKGRNDMITKNFKVNSLANSYAAAIYHDITTRNGGDWFSMKVGNKTIEVAIIDGVKGIRMLVDSYLLKALKGQYPTWEAVAISLIEQCVINGYVTGYGREVWQSMINDMGDSLADKGAFQ

SEQ ID NO: 7008 - protein, 90 aa, Proteus mirabilis
PLILIIKMIFFSFQDLCRLLITDIYFSHNNNILLLGSILFGSLATHCCSAPQDTLISSFGLIPVSQAKPSSLIIPSSRPLALLIIEPNGG

SEQ ID NO: 7009 - protein, 65 aa, Proteus mirabilis
SQINRKKSKLLSTAINCVRSNMAQIISSDTFPTIKMAYSYVAYLMQLIKIKRHLIEGIRYVLCAM

SEQ ID NO: 7010 - protein, 77 aa, Proteus mirabilis
CGVKNNHIVAHNLFLILFYFVFCALPGIKKPAISAGFSLRVGMFHFLPISRPRINVANSSRLDSKIAFNMKHPYICS

SEQ ID NO: 7011 - protein, 254 aa, Proteus mirabilis
AVTKDQKGISSDRLKAKHHHDDKETSMSTEKVLEVHQLTKQVGEGDSQISILQGVELVVESAQTIALIGESGSGKSTLLGIIAGLDDGGAGRVQLMGHDLTKMNEEERAKLRAQHVGFVFQSFMLIPTLNALENVQLPALLKGESEKQSHTRAVDLLKQLGLGERLYHMPAQLSGGEQQRVALARAFCTQPAILFADEPTGNLDRKTGDKIADLLFSLNRDYATTLILVTHDNELAARCQRRLRLVDGQLKEES

SEQ ID NO: 7012 - protein, 115 aa, Proteus mirabilis
KMTNKIDVVKRKTVPAYLDHDLEMINELREDPDYAEVYLQTALEGIYEPGGIGAFLIALRQIIEAHGGVGVIAKKSGLSRQHIYRALSENGNPTLTTLTEITRAVGVRLASTHCV

SEQ ID NO: 7013 - protein, 166 aa, Proteus mirabilis
KRHNMSYPLRKMTLADIKAVTSLLQENSQSQQGGLYGDYPHDKVEAMYQSSTNAIVATDQEQIIAVVFSFPVSSFSLPPIAQEINRRFPSLTYNNWFYGPVCIDKSYRGKSLLTELYQYIGALQGGRPIAFINSENIRSLKAHQKLGMNIVENFQFQGKAWWVISG

SEQ ID NO: 7014 - protein, 106 aa, Proteus mirabilis
MNNKLTIKSLTPAISGWWAKIHDNNEDKTEWYSPVAAWALCDVRYEKESKVYTQILPVLTGEFGMEPLHPDEAYSELLYLPNDKFVRMGGECLFAWQLLDEVTIND

SEQ ID NO: 7015 - protein, 197 aa, Proteus mirabilis
RINKMKQVAVLLADGFEEGEAVVFIDIMRRLDIHVDVLSCMDTLVLNTYFNTKISADYLLTEKFTHSYDAVMMPGGPKGTDRLCANSLVIDFIKRHIAQDKYICALCSSGAKVLAAHHLLEGRYYSTGDKLADKYDDGHYLDQDVVVDGKFISAKGLGVSFEFAFTVAKYLLSDNIEKVDWQANHIYFKHWPLSYLD

SEQ ID NO: 7016 - protein, 295 aa, Proteus mirabilis
TMNKLRIVLFLPLFGLALTSFHSHAATVNAMFSWESADYDTSNNYSGYRVDFNINPDKSNWYFDVGFRQREHDNKNRYQRYDLQGSYRFKLNNGWIQPGLKIRQDLTNYDNGSRLTIDFYESKTNYQFPINKDWVLTGSVLFGLQKKEDKRSNGVTNTDYLGWEIEPGIRYFITPNLNTTVAYFDGGKQAIRHEEYDTKETNHNQQLRMYVNWTTPIGVIISPSMRKSIFGKIEDRTNKGEYIDKDMTRYTLQMAYQISPQWRVMTEYYNERVENKNNGSKSTQDYFKVSVRATF

SEQ ID NO: 7017 - protein, 411 aa, Proteus mirabilis
SSDKFKKRSFEQATLKGTKRREIMFEPMELTNDAVIKVIGVGGGGGNAVEHMVRERIEGVDFFAVNTDAQALRKTAVGQTIQIGNAITKGLGAGANPEVGRNAAEEDREALRAALEGADMVFIAAGMGGGTGTGAAPVVAEVAKELGILTVAVVTKPFNFEGKKRMAFAEQGITELSKHVDSLITIPNDKLLKVLGRGISLLDAFGAANDVLKGAVQGIAELITRPGLMNVDFADVRTVMSEMGYAMMGSGAAKGEDRAEEAAEMAISSPLLEDIDLSGARGVLVNITAGFDLRLDEFETVGNTIRAFASDNATVVIGTSLDPEMNDELRVTVVATGIGMDKRPEITLVTNKQNQQNAMENRYQQMQNSMSSFSTVEESKPAAKAVNEQSTQANKEPDYLDIPAFLRKQAD

SEQ ID NO: 7018 - protein, 65 aa, Proteus mirabilis
FGGKYSVNTTSLLTTSADKNALLSIQLILYLKNSVIVYVKGGGNTNIHVIYLRAFVAQMGELWDD

SEQ ID NO: 7019 - protein, 634 aa, Proteus mirabilis
IKGNAMNYKEFAKQILAIVGGEDNIKSLVHCSTRLRFTLHNEDKIDPSKAKANSKILSDVMKGGQYQLVIGNDVDKVFNELTKMIKTNNTPHDNNKDQKKQSIVNKILSAITGSIAPVIPLLAGAGMGKVLLIVLTMLGWLDKSDQTYYILNFIFNTAFYFMPVFIGFSAAKIFNCNQYLAAMVCLAMVSPEWTSLVKAGEPVEFMHIPVALVKYSSQLIPALITVWMMSYIERFIVRIVPEMVKVFMVPLLVILVSTPIALIAVGPVTSWFAQLIADGVILIQEHTGFIAIPLLVAIYPWLVSIGMHKALSPVSIMLVEQKGFDPIIRVMALCSNMSQAAASLAVSVRTKNKTLKQLAFSASITAFFGGITEPAMYGVNLKLKKPMYACMIGGAIAGLFAGIVKLKAFVYVTPGLLSLPMWISDTDNQVVNAIITLLIASVATFIATLIIGFDDPTDDPIRDEEENNKQAASTNKKPQIANSKLPVGLISPLQGKTVALSEVNDETFASGIMGPGMAIIPTTGKVIAPADGVVDITFSSGHAIGLTLVNNIEMLIHVGIDTVNLAGQHFTCCVVKGQKVTKGDTLIEFDLDAIIAAGYDPTTMIIITNDDHKLDVVQTDKKHVDQNTVLLTVG

SEQ ID NO: 7020 - protein, 235 aa, Proteus mirabilis
RDLNLIIQSFYGDNMKSIILFFISLFIINTSYAGVIISGTRVIYNEGNKNVSINVKNPDKMPYLIQSWIDDFEEKKQSKFTITPPLFRLNPDKENTLRIFLTEEGLPSDQESLFWLNIKTIPATEKTENSLQIAFKTQMKLIYRPKSLKDVNFEEEQKKLSWSKERGKVIVYNPTPYFMNFQTIKFNGKLVDDVSYAKPFSTKSFDINDNNEHGLISWELINDYGANVDLSEVRI

SEQ ID NO: 7021 - protein, 271 aa, Proteus mirabilis
PRLNEINCKIMQKTVLITGSSSGIGLCAAKTLKQKGYRVLAACRKEDDLNHMETLGFEPIFLDLDDAESIEKAILEVIRLTNGRLYGLFNNGGFGVYGPLNAISRQQMEKQFSTNFFGLHQLTMGLLPAMLPHGEGRIIQTSSVMGLISTPGRGAYAASKYAVEAWSDALRMELASTGIKVSLIEPGPIKTRFTENVNQAQQDKPVKNPGIASRFTLTPDDVVKKLIHALESPRPKLRYPVTLLTYAVKVLKRLLPDRLMDRILNGQSNKA

SEQ ID NO: 7022 - protein, 150 aa, Proteus mirabilis
KMLKIRISRPSEAPEIIQIWKNSVDATHDFLTANDRQEIEKEVIGFFSETPVWVATNQEDRPLGFMFLHDGHLEALFIDASARGLGIGKQLISHALTLHPNLSVDVNEQNQQAVGFYQHMGFQISGRSELDNQGRAYPLLHLSRAKTITL

SEQ ID NO: 7023 - protein, 631 aa, Proteus mirabilis
IEVKMSMKDQETRGFQSEVKQLLQLMIHSLYSNKEIFLRELISNASDAADKLRFRALSDAALYENEGELHVRIATDKEKRTLTISDNGIGMTRDEVIDNLGTIAKSGTKAFLESIGQDQAKDSQLIGQFGVGFYSAFIVADKVTVRTRAAGQPADKGVFWESQGEGDYTVADIEKADRGTEITLHLREGEDEYLDDWRLRSIISKYSDHISLPVEIETKNEEDGTVTWEKINKAQALWTRNKSEISDDEYKEFYKHLSHDFADPLCWAHNRVEGKQEYTSLLYVPSKAPWDLWNREHQHGLKLYVQRVFIMDEAEQFMPNYLRFIRGLVDSNDLPLNVSREILQDSSVTRNLRSALTKRALQMLQKLADNNPEEYQTFWKEFGLVLKEGPAEDHANIEAIAKLLRFASTHNDSDAQTVSLADYVSRMVEGQDKIYYITADSYAAAKNSPHLELFRKKGIEVLLLSDRIDEWMMNYLTEFDGKSFQSVSKADESLDKLADEEKQAQQEETDKQLAPFVERVKTLLGDKVKEVKLTHRLTDTPAIVTTGADEMSTQMAKLFAAAGQQVPEVKYNFELNPNHPLVKQTAELTDETQFADWINLLLDQALFAERGTLEDPNKFIRLVNQLLAKNA

SEQ ID NO: 7024 - protein, 405 aa, Proteus mirabilis
FPTNIGNNMATKNIVIIGGGTGGTILANILAKKLNDEIFSKKIKITLISDNPYHYYKPAFMYIAFNLFLKEELMRSQRSLLRPEIEFVIDKAESFDFNNKTVYCCSKKKYHYDFLVLATGCVPRLDRIEGLAEAGNHFYQYEAARKLADKIATIEKGRVFITVTFPETPNVPHQCGIAPMETTLMLDEFLRQRRVRSNIEIVYTYPTVAQLLRNCLFMQQEVCEVLPAVFSERDIKAKRGFTLSHVDPDKKIAYSKEGEAEPFDILMSTPPITAVEAIRNTGLSEYNNGEGWLPTDPETLQVYGLNQVYVLGDTVDLPISKAGGSCHNQAGVIANNICGELRYGYPAAIYDGRVQAVAQMGLSAGMPLQYDYKHDVIPTPPTKLGGMLRNGYNRGLYWATVRGLL

SEQ ID NO: 7025 - protein, 361 aa, Proteus mirabilis
GTKKMKYTPQHKMDAALMAGTSLNTPNNHSIQEQHHRLKDDATVSAYMSQNYISVSVADSVEHVKAQLVNDLKDELIPTYLYVVDKDNYLNGILPVKSLLLADNGLFVSDIMRQTFFSVSPEQSRHDVYQLISQSGLDSVPVMHFGKLVGVLRPQDIADLIEDENTLDAQMQGATSPLEQPYLETSPVTLWRKRVVWLLMLFIAEAYTSTVLHAFEDRLEAAISLAFFIPLLIGTGGNSGTQITSTLVRAMALGEVSLRNVWSVLRKEITTSIMVALTMGIAGFIRAWTLGVGMEVMIVVGLTLISITVWSAIVSSIIPMVLKRIGVDPAVVSAPFIATFIDGTGLIIYFEIASHTMSVFA

SEQ ID NO: 7026 - protein, 73 aa, Proteus mirabilis
LNKNLQFYLTITRAYSKQKIKKRILLKISVLNFVNLIIFIWQYKTIKIRVSNYTSYLINIKPTLTTSKLTLYF

SEQ ID NO: 7027 - protein, 502 aa, Proteus mirabilis
LIKKRIQVADPNLSDLLGALGIQAPSLTLKDMTLDSRKAASGDLFVAIKGHETDGRRYIPQAIAQGVCAVLAEAEGIATHGEIRESHGIPVIYIENLNCQLSKLAGIFYHQPADKLKLIGVTGTNGKTTTTQLLAQWAQGLDEVSAVMGTVGNGLLDHIVPAMNTTGSAVDIQLELQQLVNQGATFTAMEVSSHGLVQGRVSALPFVASVFTNLSRDHLDYHGDMANYEQAKWLLFSTHHSGEKIINADDAVGHKWLTHLPDAVAVTMADKLPANWQGRYVQATQINYHDAGATIHFNSSWGEGEIESPLMGAFNVSNLLCALATLLALEYPLDAVIKASSALTPVCGRMEVFSANNRPTVIVDYAHTPDALEKALQAARLHCTGKLWCIFGCGGDRDKGKRPLMGAVAEQFADKVVITDDNPRSEEPQAIIQDILSGLMDPGRALAIEGRAEAVTNVIMQASPADMILVAGKGHEDYQIVGTRRLDYSDRLTVARLLGVIA

SEQ ID NO: 7028 - protein, 64 aa, Proteus mirabilis
KMENKKIIRSEIKREKESTNQDINKLKKLFSINNYHYRDINNEENQHSLIYRWPLLNTFNSITK

SEQ ID NO: 7029 - protein, 391 aa, Proteus mirabilis
IKMKLSAVVNFMETSSFSRKMMSFLLILNSLFIIYSILLSRGVYLDWEIHGFADWLKSLGILKLLDIPKVMLASALILLSFFMYMGARIAWCVSLILLVTIVFLDVAVYHQAGTQAYTSLALAIVLVISRRAFPHHSLTSAGFVAFICTISLLSFSMLGSLYIGDEFKPHITTLMDAFYFSIVCMTTLGFGDIVPISSNARMFTLTVVILGITVFTTSIVYVMGFLARGTRDIVKKRIAKMHDHFIIIGSSMLAAQLEKGLREQGKPVIAICSDKKQAMYDKEANIIEGDPTNVKTLQTANIRQASWVATLSESDAENTFILLTIQECPDLQAKLITIINKDENREKISRLRPDMLLSLASLGKEIMMKVLCGESINSSDVTDLLINKYLK

SEQ ID NO: 7030 - protein, 63 aa, Proteus mirabilis
LGAKIKKVPLSAIWLICSDKGIPVCNLFTIPLTKKGKPKFALVDNIKLNALVGRCGVRIFFNK

SEQ ID NO: 7031 - protein, 487 aa, Proteus mirabilis
QPQKWVIISLSLFKKGHNMGKTLYQKIYDAHVVREVANETPIIYIDRHLVHEVTSPQAFDGLRTKGRPVRQPNKTFATMDHNVSTQTKDINACGDMARIQMQELMKNCQEFGVTLYDLNHPYQGIVHVMGPEQGLTLPGMTIVCGDSHTATHGAFGALAFGIGTSEVEHVLATQTLKQSRAKTLKIEVQGKTANGITAKDIVLAIIGKLGSAGGTGYIIEFTGEAIEALSMEGRMTLCNMAIEMGAKAGLVAPDETTFAYLKGRQFAPQAPLWDEAVAYWKTLKSDEDAIFDATVTINAAEIAPQVTWGTNPGQVIAIDQIVPRLNSFNDPVERASAEKALAYMGLTEGVNLTDITIDKVFIGSCTNSRIEDLRAAAKIAKGHKVASHVQAIVVPGSGPVKAQAEAEGLDKIFIEAGFEWRLPGCSMCLAMNNDRLNPGERCASTSNRNFEGRQGRGGRTHLVSPAMAAAAAIHGHFADIRTFATVS

SEQ ID NO: 7032 - protein, 281 aa, Proteus mirabilis
RNKKMKLKNNSLNAGGFAHPENHSSDIKELSFAEMLPVIQGNINGQIINAVSAKALHEALGVGRDFSTWIIGRVNEYAFVEGTDYQSDDDFNIRCLLNEQYSPVLGNNTKRGRPEKDYLLTLGMAKELAMVERTEKGRLIRQYFIKCEEALHKVAPTITKQLRHQLKSRLKVASYFKPMCSALELARMEQGKSTLPHHYTTESNMLNRIVLGGLTAKAWAKQNGIIGNPRDAMSETQLEHLSYLEQTNTTLIELGMDYHARKGKLISLSQKWLAQRVEVAQ

SEQ ID NO: 7033 - protein, 494 aa, Proteus mirabilis
WNNLMNKLTPLRPIPTLIAVAITLIIWFVIPVPQGVDPNAWHLLALFVGTIAAIIGKALPIGAVSIIAIALVAATGVTNPDSTKGAINDALSGFSNNLIWLIGISIMVSMSLNKTGLGARIGYYFISLFGKKTIGIAYSLAIAETILAPVTPSNTARGGGIIHPIMRSIADSFNSKPEEGTSGKIGRYLSLVNYNINPITSAMFITATAPNPLIVSLIIGETGPENELTWSMWAIAAFVPAIVSLFLMPIVIYFLYKPEITHTPNAPHFAKERLAQLGPISLPEKITLGVFALLLIMWAGIPALLFGDAFSINATTAAFIGLSILLCTGVLNWDDILKNKGAWDTVVWFSALVMMASFLGKLGLIKWLSLSVGAGIDSMGISWVSGMILLVLIYVYSHYFFASTTAHITAMFAAFYAAGLALGAPPMLLGLILAFSSSLMMSLTHYGTGTAPIIFGSGYATLGEWWKAGFVMSIVNLIIWITLGSLWWKVLGYW

SEQ ID NO: 7034 - protein, 89 aa, Proteus mirabilis
LDLEILGILVIADFIRILWTIVDVKILENGTPYRIRTCDLRLRRPLLYPTELRAPRGEIDVSIYADNGCELYFQHSESQRFFHKIKLDG

SEQ ID NO: 7035 - protein, 105 aa, Proteus mirabilis
MSTERHSLPGVIGQDLLRHGKLPLILFFAVIISAIYVVTTAHKTRLLTAEKERLVLEKNVLDIEWRNLILEENALADHSRVERFASEQLGMVHVDPTKENIVVTK

SEQ ID NO: 7036 - protein, 486 aa, Proteus mirabilis
LYNDNYSLHERNCFEMAISRRKFILGGTVVAVAAGAGILTPMLTREGRFVPGTPRHGFVEGTGGPLPKQDDVVVIGAGILGIMTAINLAERGLSVTIVEKGNIAGEQSSRFYGQAISYKMPDETFLLHHLGKHRWREMNAKVGIDTTYRTQGRVEVPLDEEDLENVRKWIDAKSKDVGSDIPFRTKMIEGAELKQRLRGATTDWKIAGFEEDSGSFDPEVATFVMAEYAKKMGIKIFTNCAARGLETQAGVISDVVTEKGPIKTSRVVVAGGVWSRLFMQNLNVDVPTLPAYQSQQLISAAPNAPGGNVALPGGIFFREQADGTYATSPRVIVAPVVKESFTYGYKYLPLLALPDFPVHISLNEQLINSFMQSTHWDLNEESPFEKYRDMTALPDLPELNASLEKLKKEFPAFKESTLIDQWSGAMAIAPDENPIISDVKEYPGLVINTATGWGMTESPVSAEITADLLLGKKPVLDAKPFSLYRF

SEQ ID NO: 7037 - protein, 554 aa, Proteus mirabilis
KEFDMYCVQCEQTMRTPVGNGCAYAQGMCGKTAETSDLQDLLVAVLEGLSAWALAARSVDIIDHDIDSFAPRAFFSTLTNVNFDSERIVGYAKEAIYLRESLKSRTLAKNAAIQVAHPKAEIQLEGNDLASLQKQAQRFALNNDKAQVGDDLHGLRMLCLYGLKGAAAYMEHAHVLGQYDDEIYAEYHRYMAWLGTDPADMNELLDNAMGIGQMNFRIMALLDKGETQAYGDPTPVSVNVRPVAGKAILISGHDLKDLQMLLEQTEGKGINVYTHGEMLPAHGYPELKKYKHLVGNYGSGWQNQQSEFAKFPGPVLMTSNCIIDPNVGNYGDRIWTRSIVGWPGVKHIKGDDFSEMIEQALSLEGFPYSEIEHLITVGFGRQTLLNAADTVIDLVSQKKLRHVFLVGGCDGSRGERSYYTDLARAIPQDCLIMTLACGKYRFNKLDFGTLEGLPRLLDVGQCNDAYSAIMLAVNLAEKLGCGVNDLPLSLILSWFEQKAIVILLTLLSLGVKNIYTGPTAPAFLTDNLLAILNEKFGMRAITTPEQDLQEILSA

SEQ ID NO: 7038 - protein, 198 aa, Proteus mirabilis
SALDYLRPKSMFKKIIILLFFTKIFSTYASGAVLDKYIPSDKVWWQGTAKFLGKVISPACTLDMDSKYQLVDLGTIPVNKMNNNDDLLASKKIKIKLSDCQFINKTKNIDKVKGVTLTFYSDVSGSKADLFSFNNSDEVYFKIIDEYGYSANSGESLPLIYVDGDNTYLYYKIDVVKKLDVITPGDYYASVLFKINYE

SEQ ID NO: 7039 - protein, 244 aa, Proteus mirabilis
LINDKGLEMKKISFLLLGLMVTSNSYAAISLDRTRAIYEGGSNALVINITNDNKQLPYLAQTWIENDKNEKIELGPLIATPLVQRLEPGDKALIKVSATPDIEKLPNDRETLFYFNVREVPPKAEDNNVLQIALHTKIKLFYRPKQILREPNAIWQDQLVLNKLSDGYEIENPTPYYVTVFGIGGSKKEAVDSEFNAVMIAPKSSQRVNSKVYSTPYLSYINDYGGRPTIKFQCQANRCVAEKK

SEQ ID NO: 7040 - protein, 244 aa, Proteus mirabilis
VALFMCTLFIADLHLSEHEPAITAGFLRFLQEQAIHANALYILGDFFDFWIGDDDPNPLHQRIAQALMALKNAGVPCYFIHGNRDFLIGSRFAKESGMTLLPQEKVLEIEQHRILILHGDTLCTDDEAYQRYRKKVHNKFIQRLFLLLPLTIRLRIAKKMRSRSQSSNQYKSEAIMDVNAQAVINTFKQFNTQWMIHGHTHRPAIHTVDIDGKPHYRGVLGAWHTEGSMFKVTSDKIELIQFPF

SEQ ID NO: 7041 - protein, 193 aa, Proteus mirabilis
FKVDHMVIYFYREWVKILFFMLIFLPVANAATTMNFDGTLIDTPCRIDQPSLNQNVVFLNSTPRDYWKYPAVRPAEKFTIKLIQCDAKSLWKSVKIKFNGQPEPEMGAEQQKYLTLSSGVNKSKLAIGLIDIDGNQRITLGENHNGGNGTQLNDGTMLLTFNAFVEATPKAIQEKSVVPGVYNATVEFEVSYE

SEQ ID NO: 7042 - protein, 425 aa, Proteus mirabilis
GIADMYSTIEQANEAVIERIREARPHWCDVSLAKEVVPTLATGKKLLHAGPPVTWQEMSGPVRGACIGASLFEGWAENEAQALAMLEAGEIEFIPCHNVNAVGPMGGITSAHMPMLVIKNHVHGNYAYCNMNEGIGKVMRFGAYGPDVQERLHWMRNSLAPVLKAALATIENGIDLTAIMGQAITMGDEFHQRNIAASALLLRELAPILSTLDLDAAEITKVTKFLSITDQFFLNLAMAYCKAAMDAGAQIKQGTIVTVMTRNGSNFGIKISGMGDQWFTAPVNTPQGLFFSGFSQADANPDIGDSAITETFGIGGAAMVAAPGVTRFVGASGGMDAAREVTEEMAEIYLARNMMLQIPTWDFQGACLGLDARRVVETGITPLINTGIAHKEPGVGQIGAGTVRAPLGCFEKAIVALAEELGIEA

SEQ ID NO: 7043 - protein, 455 aa, Proteus mirabilis
MQKENKLSRGLSGRHIRFMALGSAIGTGLFYGSAAAIEKAGPAVLLAYLIGGAAVFMVMRALGEMAVHHPVAGSFSQYASHYMGPLAGFLTGWNYVFEMLIVCLADVTAFGFYMKLWFPDVDQWIWVLGIVCFIGALNLCHVKIFGEMEFWLSIVKVTAIIAMIIGGVAIMIYGFGQQTEHPIGISNLWEFGGFMPNGIEGIIASLAIVMFAFGGIEVIGITASEAKDPEKTIPKAINAVPFRILLFYVLTIFILMCIFPWQQIGHNGSPFVQIFSNLGINSAANILNLVVITAAISAINSDIFGAGRMMYGMAQEGQAPKSFMKLTRNGVPWMTVLVMSVVLLLGVVLNYLIPEKIFVLIASIATFATVWVWLMILLSQVAMRRQMSAEEAKKLKFPVPFWPIAPAITIIFMAFVIAILGYFESTRMALIVGLVWVAILTVGYYIGIKPRITQK

SEQ ID NO: 7044 - protein, 74 aa, Proteus mirabilis
CKKDSDTILRSSLTFKGRVKYSKAPALNALRQLSIDASPEIIITGMIFFNLFNSFTNAIDGDALLLVLIMMHSL

SEQ ID NO: 7045 - protein, 70 aa, Proteus mirabilis
NFRDEEIQRNTSLDQQKTPYIVDVTLTYVLSINHSASIDTTDINTHLVMIRFGLIEKYLYKGDISITSSI

SEQ ID NO: 7046 - protein, 398 aa, Proteus mirabilis
CQGDIMTQSNKCFNTQAIHYGYSPLDYQGALVPPVFQTSTFAFPTAQYGADCFAGKEKGHFYTRISNPTLDLLEKRLAQLEQGDASVVFSSGMGAITSTCWSLLQPGDELIADMTVYGCTFTFFNHGLAKFGITIKHVDLTDPEKLAEAITDRTKLIFFETPANPNMRVSDIEKIANIAHQHDVLVMVDSTYCSPYLQKPLTLGADIVVHSMTKYLSGHGDVMAGAIITNYQLADKIRVEGLKDMTGACLSPHDAALVLRGIKTLSIRMEKICQNAQLIAQFLENHPKVATISYPGLNSFPQYELAKKQMALPGGMISMELNGGIKAGREFLNRLMLFTRAVSLGDCESLAQHPATMTHATYSAQERQRHGISDGLIRLSIGLEDVDDLIADLTQALA

SEQ ID NO: 7047 - protein, 591 aa, Proteus mirabilis
QEGELMPHSTPLITTIVGGLALAYILGMIAQRLKISPLVGYLAAGVLAGPFTPGFVADTSLAPELAEIGVILLMFGVGLHFSLKDLMAVKAIAIPGAIAQITVATLLGLGLSTFFGWGLFSGIVFGLCLSTASTVVLLRALEERGLIDSQRGQIAIGWLIVEDLAMVLALVLLPAIANMLESSDQTSISQLLINLGITIGKVVAFILIMMIVGRKLIPWILAKTAATGSRELFTLCVLALALGIAYAAVTLFDASFALGAFFAGMVLNESDLSHRAAQDTLPLRDAFAVLFFVSVGMLFDPMVLIEHPLGILATLAIIIIGKSLAALVLVRMFGHSRRTALTISASLAQIGEFAFILAGMGVALNVLEPDARNLVLAGALVSIMLNPVLFSLLDRYLAKTETKEEQEQLQQEEMEEEMPVPVDICGHAIIVGYGRAGSMLAEKLQPQAIPLVIIENSRNKFAELKEKGLNAVLGNAMTKESLALARVDCAKSLLLTIPNGYEAADIAETARKMNPDLNIIVRAHFDDIIVRANYDEEASFILEKGANHVIIDEDQTASAMAEMLIQEVEFGCTIDDTPEEGQQIIAPNAAQ

SEQ ID NO: 7048 - protein, 315 aa, Proteus mirabilis
KMTDYTSATTTNKESADMHLRNVDLNLLTVFDAVMQMQNVTRAAQVLGMSQPAVSNAVSRLKIMFNDELFVRYGRGIQPTLRAKQLFGPVRQALQLVHNELPGAGFEPEQSDRVFSLSICSPLDIKLAPKIVERIKNKTPNINVNIKSYLNSNIEHQLKYQEVEFFINYKQFDKPEFHSHPLFNDEVVLAVSNQHPRIKESVTEEMLLNEHHSIVSLEDVGSFSAAYYKNTELEDLITYEGTDLNSVLNLVSKTYSVAIAPRWLVESYSEQLNIKAISLPWEKVERPCYLIWHESTARDKGHLWMKNLLSEVCQN

SEQ ID NO: 7049 - protein, 89 aa, Proteus mirabilis
LKSLICGFDTKGSISTVTLSDYGDNHHSTALIFELCYVFNQLQGAIIRFACFTVSYLNFKLWTYSLNPLAMIHFLICITLLYTDIISAH

SEQ ID NO: 7050 - protein, 77 aa, Proteus mirabilis
YFVCSQSVQTHFYIFISMMKLTKLFMTHNFTNLCKIRFLYFCGSLRLPDKSANRCKLKLEDDIILYFNLIIPTLFHK

SEQ ID NO: 7051 - protein, 360 aa, Proteus mirabilis
MLVWLAEYLVKYHTFFNVFSYLTFRAIVGLLTALIIALWMGPHLIAWLQKMQIGQVVRNEGPESHFSKRGTPTMGGIMILFSIAVSTLLWARLDNPYVWCVLLVLIGYGIIGFIDDYRKVVRKDTRGLIARWKYFWQSVLALAVAFSMYAIGKDTPATQLVVPFFKDVMPQLGMLYILLAYFVIVGTSNAVNLTDGLDGLAIMPTVFVAAGFALVAWATGNVNFASYLKIPYLMHAGELVIVCTAIVGAGLGFLWFNTYPAQVFMGDVGSLALGGALGTIAVLLRQEFLLVIMGGVFVVETLSVILQVGSFKLRGQRIFRMAPIHHHYELKGWPEPRVIVRFWIISLMLVLIGLATLKVR

SEQ ID NO: 7052 - protein, 189 aa, Proteus mirabilis
FIYCASFLLLRVLIRRYMLSNMKTVRVPIALVQSVMRTLREKLQQANKYLNTDYPEPTLQYNQRGTIAGSAYYANWEIRLNPTLLIENKQNFIEEVIPHELAHLLVSRHFGRVAPHGKEWKWMMETVLQVSAKRTHHFDISNVTAKTFSYACRCQEIHQLTLRRHNKVQRGETQYRCRHCQAILQLIKE

SEQ ID NO: 7053 - protein, 106 aa, Proteus mirabilis
SCHCSIKPVQQRIHLCREGLIMGCYPENYKRIQAEISNMLGNDLLLSSEERSRDRLLRVRKGMAHILSEVFPLIDDPKKQELYYWLEAISRISGAEAVDAKSKGEA

SEQ ID NO: 7054 - protein, 285 aa, Proteus mirabilis
IMELVTYKTLPEWHLTAIPLALLERHNTKEGTYAQMRILQGSMTFVLFKDDGEQVFLECDSENQPPLIQPQQWHKIDKASDDVLCQLSFLCTPEDKFFKENDLSLPHSEVRYMATLTTPCKVLDLGAGRGRNSFYLALQGYDVTALDINAAHIDAIEAVKAKTGLAIKSGLYDINEAALNEKYDIIISTVVLMFCQRQRIADIIKNMQECTNPEGINVIVCPVETANSGSAEVPFKTFLRQGELADYYQGWDIIKYNENPGHLHKTDANGNRIQLNFATLIARKK

SEQ ID NO: 7055 - protein, 133 aa, Proteus mirabilis
LINCDYFFGLKRNNRLALLTTVIDDKAMAAPATTGFNNVPVKGYKIPAAIGMPKLLYINAPNKFCFILRSVPFEISTASATPCKLWRIKVMAAVSMAISLPPPIAIPTSALASAGASLIPSPIIATRRPSACS

SEQ ID NO: 7056 - protein, 71 aa, Proteus mirabilis
MQICNKQGAHKKRYLFANSNTVNDNIFTRNILVETTATSRNGFDFVYNIHSFNNFSKYTISPTIGIFCTEV

SEQ ID NO: 7057 - protein, 223 aa, Proteus mirabilis
KIKCKGIYAMRIILLGAPGAGKGTQAQFIKENYGIPQISTGDMLRAAVSAGTELGLKAKALMDNGQLVTDELVIALVKERIKQDDCRNGFLLDGFPRTIPQADAMKEAGINVDFVLEFAVPDEIIVERIVGRRVHAPSGRVYHIKFNPPKVENRDDVTGEELTTRKDDQEETVRKRLIEYHSQTAPLVSYYQNEAKAGNAQYHKIDGTQKVSEINAELKNILG

SEQ ID NO: 7058 - protein, 1092 aa, Proteus mirabilis
VMMWRICYQYRQYLLALSLLAGILPVTQAADDPTETFLYEQVRLGNSKSNDVLVSQSLYRLSLIKPNDPSVLLMCIQFAVKQKETAKAQQLVEQLRMHGENTEQYQRAIRLLSLTHEDNRQILQKAYLYQTAGRYDEALQLYDDIYQGTPPDEGLALEYLNVLIASSHANKMARIKQIYHTYPNNQQIANIYQQYHLTPALSTASAGSVSYNTLSIRALKQQLRQQPDNADIIGTLGVRYSRANQRAPAIYYLSQALTLSPKHDDSDLWRTLLQSNQYWHLLAKADEALLNQEYSAAKHYFTQVRQLSPYKSEAYIGLGDIELAQHQLEQAERYYQQALQYQPNDAATLHSLTKLYRQQSHQKAAQFMANLTSQQYKNLAQDYGYIISGIQQDLAADDEQQQHYLSAIEKRKAIAKAYPDEVWNIYRLADDLLITQQPQLAEDYFNQLNQRRPNDPSRRYAYALYLNKTGRAQQALNTLKTIPLSQRSESMNALDSQLRFGQIMAHAQSLREHNQQQQAVEYLFTHIPPEQKIESYLLLAQWAEEDDQLNQALNYYHTVLNLAPNNETALLGATEISLAQHQIDQARYYLAQIEQLSPEKFNHYSLRRLANAEKTTGNIDKAKHYFIYLARQVDKEPDSADGLILRDIGRFYRDSQQVQSAHHYYQQAMLKEGITHTLPKNNIEYTTLMRNNLNDNWLSRSVRDDASTLYRQQEWRFTLEHDYWGSNGSEGYSKLRAHTTMLQLDHPIYHGRFFWRTDFVHLNSGTLGTAPYDAKFGSCYRTGCFPLKQKAFGVSPAIGWENEQWQWDLGTTPLGFNVTDWVGKIAYNDSFYHLGWSVDLHRRPVNSSLLAFAGQRDSWTNQVWGGVRKTGLRLSGSYDLGGKDGYWGEISFDRLTGKNVKNNSSVKAMGGYYYKLINENDRRISVGLNSMLWHYNKDLSGYTLGQGGYYSPQQYLSFSLPVNYHQRTENWSWEVSGSLSWSYSKTDDSRRYPLQNLVSSDKFNSDPIKEIFKHERNIIDKGDSGHGFGYTARALIEHRITPHWFIGAAIDIQQAKNYTPSHALMYLRYSFDGWNGDLDLPPNPLIPYADFK

SEQ ID NO: 7059 - protein, 76 aa, Proteus mirabilis
LNVWISVTCGMPSVKVPVLSKTKVSNWLACCNASASRTNTPYSAARPTPEIIDMGVANPRAQGQAIINTVVIMTSA

SEQ ID NO: 7060 - protein, 361 aa, Proteus mirabilis
SVSREGGTINNSGNLTINGNSVHLQGAQVNSKDTQLTSQSGDIEITSAQSTDYKNNWGTDIGFNGKKTNTTPKEVTEEKPATSIHNIGGKLLVNVEDQQKTSHQNATLETGTLTINSNKDLTLSGANVTADSVTGNVGGSLNIASQKESNRHVTVGVNVGYNHTNDPKSSQVNKTAKAGGSLLEKTIKDTIDSGIKSSTDAISDKYNSLSSTIADKTGISDETKAKIDQGFGKVGNGIKNIVTGAEGHTANADIKVTHVDNDAVTKTTSLTSNNDLSLNVNGSTKLTGAEIASKQGQVDLGGSSVKLENIEGHHYEAGADLDLKSSVVDLAKQLVGGDISFKSPVKTNETVNTKASISEKK

SEQ ID NO: 7061 - protein, 338 aa, Proteus mirabilis
QPNRANIMASLKDVARLASVSLMTVSRAINNPELLKPDTLKQVQRAIEELNYVPDFSARKIRGQGTKVSSIGVLGIDTATTPFSVEMILSIERTARQFGWSSFVVNLTEQEGYDQAIWQLLAQRPDGIIYTTMGLREITVHEKLRDKNVVLANCLAKDQTFPTYIPDDYHGQYFAIKHVIEKGYRHPLCFYLPEDTVAGPIRRKAVEDAWQDAGLPLSSLRQYTMLFGDEHYRDVIGLLQQHCRQQKADFDILICGNDRIAFLAYQVLLSMGLRIPEQVAVLGYDNMIGTGELFYPPLTTVQLPHYDLGKEATLHIIQERNHNKTVQVPCQLIERESL

SEQ ID NO: 7062 - protein, 119 aa, Proteus mirabilis
AKDRKGGYMKPLQLFKILGDQTRLDIVLLLKASGELCVCDIYTALNLSQPKTSRHLAMLRESGLLLDSKQGKWVHYRLSPVLLPWVKNIIDITYTTEKNRVADLLKILEKKESGHRCSV

SEQ ID NO: 7063 - protein, 214 aa, Proteus mirabilis
SRGRKNMLSRSMKDLLTMLKQHGINDERLLEAMSKVPRELFIDEALSHKAYENTALPIGNGQTISQPYIVAKMTSLLELQATDSVLEIGTGSGYQTAVLANLVHHVSSVERIKILQWQAKRRFKHLDLHNISTRHGDGWEGWVSKGPFNAIIVTACATEVPQRLLMQLADGGRMIIPVGEQQQMLKFIRRLGNDFHYQSIEAVRFVPLIAGELA

SEQ ID NO: 7064 - protein, 363 aa, Proteus mirabilis
KIMLKKLRHTLLSTLIISGTFLSSITTAQACTRVVYLGENNQIITARSMDWKYEIGTNLWIFPQGMQRSGEAGDNSVQWQSKYGSVIASGYDISTTDGINEKGLVANLLWLAESDYPSYSKDKPAMAISAWAQYVLDNFATVEEAVTALKDEPFIVLTDKVPGQDRVATLHLSLSDSSGDSAIIEYIDGKQVIHHSRKYQVMTNSPIFSEQLALNSYWQQIGGTVMLPGTNRASDRFARASFYINAIPKSQSSKKSLASVFGVIRNVSVPYGLSTVESPEISSTRWRTVADHKNQLYFFESALSPNTFWVDLKQIDFSKETGKVMMLALGQEQSTIYSGDASSQFKPAKPFKFKGLENIPIQN

SEQ ID NO: 7065 - protein, 546 aa, Proteus mirabilis
RKTRANRGFFYTWESAKNEIKKYKEQIMSNNVIIFDTTLRDGEQALQASLSVKEKLQIAYALERLGVDIIEAGFPVSSPGDFESVQTIAREIKNSRICALARCVDNDIDVAAESLNIAEAFRIHVFLATSALHAEHKLKKSFDDIIEMGTRSIKRARRYTDDVEFSCEDAGRTHIDNLCRIVESAINAGATTINIPDTVGYTTPYQFGGIITNLFERVPNIDKAVISVHCHDDLGMAVANSITAVQAGARQVEGTINGLGERAGNCALEEVIMAIKVREQMMNVQTRINHKEIYRTSQLVSQLCNTPIHANKSIVGSNAFAHSSGIHQDGVLKNRETYEIMTPESIGLKEVQLNLTSRSGRAAVKHRMEEMGYRETDYNLDSLYAAFLRLADKKGQVFDYDLEALAFMGQQQQEPDEFVMNYFNTQSGSSTVATASVSISRKNEEITEAATGNGPVDAVYQAISRATGYPLKLVTYQLTAKGEGRDALGQVDIVVEYQGRKFHGMGLETDIVGSSANAMMHVINSIWRSEQVEIEKRKHHTTQEAV

SEQ ID NO: 7066 - protein, 614 aa, Proteus mirabilis
LFLRFSINNRKIMINNNNLYDYHIIRRLQMQFSSSGEKTAYRQWEAKSEIAMSWASVAKKTRALSNALLDMGVAVQENVGIFSQNSIDWSIADIATLQLRAVTVPLYATSSVEQAAYIINDADIRILFVGDQKEYDVVSELALLCPQLKHIIVFNSQVVLNPTIPSYHLTNLISDCQSQYDSLLQQRIDECCLDDLFTLIYTSGTTGEPKGVMLDYTNLASQLYLHDQRLSLSDKDVSLCFLPLSHVFERAWSFYVMHTGAINVYLTDTHAVREAMAAVKPTVMCAVPRFYEKVYSAIQEKVSQAPRLRQWMFKWALKQGEKQRQAHLAGRSLGVLSQWCYRFADKKVLQPLRQILGGRVRFLPAAGARLDDAVIGFFLAAGINIKYGYGMTETCATVSCWEENHYKLGSIGTPLPGVEVRIGEENEIQVRGSIVMKGYFNKPEETVAAFTEDGWLRTGDAGALDEDGMLYITERLKDLMKTSNGKYIAPQMIEGTLGQDRFIEHIAVIADTRKFVSALIVPCFDALEEHARALNLKYHDRIELLRHTKIKELFDERLREMQRNFASFHQVKRFTLLAEGFTMESGELTPTLKLRRKIISERYRNEIEQMYQES

SEQ ID NO: 7067 - protein, 360 aa, Proteus mirabilis
MSERKRRLMVMAGGTGGHVFPGLAVAHYLQSQGWDIRWLGTADRMEAQLVPKHGIEIEYIRISGLRGKGVKALIAAPIRIIKAIFQARRIMKRYQPDAVLGMGGYVSGPGGVAAWSCGIPVVLHEQNGIAGLTNRWLSKIAKRVLQAFPGAFANAPVVGNPVRDDVLALEAPAERLKGREGAVRVLVIGGSQGARILNHTMPVVAGLLGERVTIWHQAGKGSENDTKLRYQNELSKNSVKSEYKVTEFIDDIAQAYQWADVVVCRSGALTVSEIAAAGLPAIFVPFQHKDRQQYWNALPLENAGAARIIEQNDLTPEAIADTLENWDRHQLMLMAEKAQSVAITDATERVANVIIEVAKK

SEQ ID NO: 7068 - protein, 469 aa, Proteus mirabilis
KWERPLMLKIFNTLTRQKEEFKPIHKGKIGMYVCGITIYDLCHIGHGRTFVAFDAITRYLRYLGYDVNYVRNVTDVDDKIIKRAIENNETCEQLTTRMLAEMHKDFDALNILRPDSEPRATHHIAEIIALTETLIKRGHAYVAENGDVMFAIDTDPDYGLLSRQDLEQLQAGARVEVANVKRNPMDFVLWKMSKPGEPSWTSPWGEGRPGWHIECSAMNGKELGHHFDIHGGGSDLMFPHHENEIAQSTCAHDGPYVNYWMHSGMVMVDKEKMSKSLNNFFTIRDVLAYYDAETVRYFLLSGHYRSQLNYTEENLKQARTALERLYTSLRGTDANAQPAGGEAFEAQFIEAMNDDFNTPEAYSVLFDLAREVNRLKTVNMEAANGLAAVLRKLAKVLGLLEQQPEHFLQSGAQADDADEVEKIEALIQQRNDARKNKDWAAADAARDALTAMGIVLEDGPQGTTWRRNS

SEQ ID NO: 7069 - protein, 394 aa, Proteus mirabilis
RRRRLMNQRYAILADRTFTPEGIRYLCYVHVNGENIESITTQAPTDCPVIRLKGKSLLPGFVDIHIHGREGADVMDATQQGLQTIADALVKTGVVAWVATTVTAPMEDIRHALLQVREFVSKPQATGALLLGSFLEGPYFTERHRGSHPVKYLKAPTICELETLLDSAGGSLLRVAVAPEAEGAMNAIDWLVSRGIKPSVAHTAATYEQASRAFSHGADCGVHLYNGMTGLHHREPGCCGAVLYHSVLAELIADGIHVHPVMMQLAYRMKGYQQIALITDCMRAGGLADGDYTLGAQTVTVTNGQAKTADGSLAGSTCSLDSALRNMVQLAHIPEWEAVQMASAIPAEYLGIGDKLGYIKAGQQASFAVVDECFHLTDTFIRGNHIYSVSGDNA

SEQ ID NO: 7070 - protein, 316 aa, Proteus mirabilis
LVGRIILRDKMMIKQRTLKRIVQATGVGLHTGKKVTLTMRPAPANTGVIYRRTDLNPPVDFPADAKSVRDTMLCTCLVNEDDVRISTVEHLNAALAGLGIDNIVIEVDAPEIPIMDGSAAPFVFLLLDAGIEELRTAKKFIRIKETVRVEDGDKWAEMRPYNGFKLDFTIDFNHPAIDASTQRYKLDFSAESFMSQISRARTFGFMRDIEYLQSKGLCLGGSFDCAIVVDDYRVLNDDGLRFEDEFVRHKMLDAIGDLFMCGYNIIGEFTAFKSGHALNNKLLQAVLAKESAWEFVTFEDEAKMPVAFKAPSTVFA

SEQ ID NO: 7071 - protein, 160 aa, Proteus mirabilis
IITLREMRMFRGATLVNLDSKGRITVPSRYRTTLNEASEGQMVCTIDLNQPCLLLYTLPEWEKIELKLAALSSMNPAERRVQRLLLGHASECQMDSAGRLLLASTLRQHAGLTKEVMLVGQFNKFELWDEQVWYQQIKEDILAEQTSQEPLSTRLLDLSL

SEQ ID NO: 7072 - protein, 76 aa, Proteus mirabilis
KDMRKNPIHKCIRLITHYSGLYFRYFNRRENLLFKRKYSQQLINFVHTMHVLLIIKEQNYSYTPQRQSIKISKNNH

SEQ ID NO: 7073 - protein, 298 aa, Proteus mirabilis
KFYRNIIMKKVIGVYKAPRQHWVGDGFHVRSLFSYGDHGKYLNPFLLLDRAGPTDFPASQGHNRGVGEHPHRGFETVTIVYKGEVAHHDSTGEGGVIGPGDVQWMTAASGILHQEYHSDAFNQAGGILDMVQLWVNLPSHAKSAPAGYQLLKESAIPVLPLANDAGQLRVIAGEYHQTQGAAKTFSPVDVWDIQLKSGKSTTLPSKKDRYVGLVILHGSAYLDSQTQLNTGDLVILDNQGGSINLEAIEDAVVLYLSGEPINEPVVGYGPFVMNSKDEIRQAIDDFNQGKFGRIPNEI

SEQ ID NO: 7074 - protein, 65 aa, Proteus mirabilis
FIYRNAGNNFADYQHLFKGELHVEIANNVEENRGGKAQGIHSIHHTAVAFNHSTEIFYATVSFYG

SEQ ID NO: 7075 - protein, 183 aa, Proteus mirabilis
SLCSREKIKTDFGDRKVKNRKFIFMLMLYINGLFISQIGFAEPVARDKSFFNINRAKIDFYNQNEKNQHGFIYIKGSFLNAPCELISNEISLKELYIKDIDVVIGGCNIYSDFKNSSNSKPAFTSVLSFTNKINDNVENIDIRMNRLKHYKDNVILNYLFSDEIKRNILDRKLNILTLKLQYN

SEQ ID NO: 7076 - protein, 421 aa, Proteus mirabilis
HSVRSVIMNDAQVNESKGKVPYWVKLTIIFFFGWIALYGSRAIVGPLMVNIGAEFDLTKAQLGSIMSIFFIGYTALNIPSGIIGDYLGKKKVLVTGVVLFGGFTIIAGMMPTYVTFMFAWVMVGVFQGFYYGPQYGLSSEAIPKHRITLGSAIINSGMAFGLSIGYYISSISVGEMGMSWRAPFYIIGVPIIIIGLMMLWIIKDKPKTKATDSAPNAPKQKTKLTFKDLFGNRNINLAYITIFCSIYGFFVLVTWLPYYLETERGITGTQISTIASLMPWFAIPGSLLFSWFSDKLGRRKPVLLIMLPLSLVAILAVPMSDSMPVLIGALILYGIVGKISTNPVLVAVVADNSPRHALGTSFGVYNCIGMLGSVFAPTLTGFLSDKTGSMDSGFYFAAILICIGIVASLFIKENPDATATN

SEQ ID NO: 7077 - protein, 171 aa, Proteus mirabilis
NIIRELVMNTPNIVWTRIDERLLHGQIRITWGKHTEANLILVANDDAAEGPNAAFMQAGMKASAGGEYAVRFFSIQKTIDVISKASPRQKIFVLCNNPTDVARLVEGGVPITHCNVGNMHFHEGKRQIAKTVSIDEKDLSAFKRLIEKGVTCTVQNTPDQTPVDVLTLASA

SEQ ID NO: 7078 - protein, 290 aa, Proteus mirabilis
MSARIIDGKTIARTIRSEVAEKVKQRIKIGKRAPGLAVILVGDNPASQIYVASKRKACDEVGFISRSYDLPDTTSEADLLNLIDTLNEDNTIDGILVQLPLPAGIDNVKVLERIHPDKDVDGFHPYNIGRLCQRAPKLRPCTPRGIVTLLERCNIPMNGLNAVIIGASNIVGRPMSLELLLAGCTTTVTHRFTKDLRFHVEHADLVVVAVGKPNFIPGEWIKPGAIVIDVGINRLENGKVVGDVDFAQASQRAGWISPVPGGVGPMTVATLIQNTLQACEEYHDPDIGNN

SEQ ID NO: 7079 - protein, 71 aa, Proteus mirabilis
AQGLLLMQYYHLTVHAKNFVASLPHMVWLKKIKLFLLMSYSFKPSYFLGLHKPQSLILIIDSVLGLVINNA

SEQ ID NO: 7080 - protein, 174 aa, Proteus mirabilis
MRKSFIAMLIATTSIFVANNALAADGTIDFTGEIIDNACELAAGSDALKVNLGKVSKTALPSAGVTAAATKFTIKLINCPATVSTASVKFDAESYSGDDTVIALKQESGVATGVGIQITDDANTVVPLFTASKTYPLKEGVENNLDFRARYIAKTDSVTAGLANANATFTINYN

SEQ ID NO: 7081 - protein, 68 aa, Proteus mirabilis
QPKRKLKMNDTDLILETDVYKWLGLKRTALWRLKKKHEFPLPVLNRPAKYRKSLIQKWLDDGGVNRKK

SEQ ID NO: 7082 - protein, 265 aa, Proteus mirabilis
IFRRKTMALNGKVILVTGAAQGIGRGIALRLAKEGADIALVDLKADKLSDVAKEIEALGRKVTTFAADISNRDEVFAAVEHAEKTLGGFDVMINNAGIAQVKPLADVTPEDMDRIFKINVNGVMWGIQAASEKFKALGHKGKIINASSIAGHDGFAMLGVYSATKFAVRALTQAAAKEYASAGITVNAYCPGIVGTDMWVEIDERFAEITGAPKGETYKKYVDGIALGRAQTPDDVAALVSFLASDDSDYITGQAILTDGGIVYR

SEQ ID NO: 7083 - protein, 379 aa, Proteus mirabilis
IRHGLSRTQGQVNQSISKVVSATCRGGAMITLCSIKGIAYQVNNSLLAGGESVKVDALLSILNLTLSYSQSDKLSSDHSANILAQYSAKSFAQQSAKTLADVSAKTYANQSILTTNGGWDKGKHSKSEEFTPFIKGDFSHLSKEANYPHWQGLIGVTTQGRIEFFESIKKGGQSATLGNVDIKYRASENYENSIHLVIGKDDNLELIQKCAIHHLHLWVIVGYSDQALAKSSVRIGVLNQLLATHDAPCVFFCVHAYAHPLNAVLYRAESMVAAAEQPKGWLDSSNSSNANSTVVTTPEIGVSSGDSLTKLLEIIVMMATPTQTQFKFLFLSIKRSDTTAKPCRIAVTAPNEHDARLMLVRDYILSFAGRLPVKEVAHA

SEQ ID NO: 7084 - protein, 226 aa, Proteus mirabilis
MKNGKLSFDAKIISSVLVSICRFLTGIRAKQISPIEKDKPCIYYANHSSHLDGLVIWSSLAPHIRPFVHPVAAEDYWNKNRLRRYLSRRIFRAVLIPRHANKTNVTEGNGETTTAPQKVNALTLMQAVLDKGESLIIFPEGTRGNGESIQDFKAGLWHLSRNNPQAQLVPIYLENLNRVLPKGSRLVVPIICSATFGPPIEPTHENEDKTEFLLRAKSALEELHHG

SEQ ID NO: 7085 - protein, 472 aa, Proteus mirabilis
PINGCTVIGGDRMIALSLETIAQVTQGALSTITQSQANQLMIKSISTDSRKIDDACLFIALAGDRFDAHDFIADVKQKGAVAVLVNRKIDVECPQIIVKDTRLAMGHIAAYIRSLSNAKIVALTGSSGKTSVKEMTASILRHCGETLYTHGNLNNDIGVPLTLFRLTPEHRFAVIELGANHIGEIAYTVDMVKPDSALVNNLFSAHIEGFGSLQGIAQAKGEIFTGLKEQGTAIINQQSNDVALWQQHFNSRQTQWSFSLSADTQADFYPTDIVVNQLTTDFTLHTPEGCVAITLPLPGRHNIANALAASALALSVGATLTDIQQGLAVLKAVPGRLYPVELTTGKIVLDDTYNANDGSMMAGLQVLSQLPGYKIFVAGDMAELGEDSEKCHRDVGRFAHQVGIDRVLTVGHYSQFISQENEGGEHFSFKADLLTQLIPLLQQHDVVSVLVKGSRSSAMEDIVNALKECFEC

SEQ ID NO: 7086 - protein, 245 aa, Proteus mirabilis
KNIFHHPFFLFIYCTGRQLFMFTPPAAPENESVLLARAQALAGYTFGELAAFAQLPIPENLKRDKGWVGMLLEYYLGASAGSKPEQDFSHIGVELKTIPIDRFGMPLETTFVCVAALTGNSGITWENSHVKRKLSKVLWVPVEGEREIPLAQRRVASPLLWSPNHLEEELLRHDWEELMDMIVLGKVESITARHGQVLQIRPKAANSKALTEAIGENGQRIMTLPRGFYLKKNFTALLIARYFQL

SEQ ID NO: 7087 - protein, 496 aa, Proteus mirabilis
KTSGLFLIGVTMGLAAIKTNQLIAGEIAQSGGVENYLKTQQNKGLLRFLTCGNVDDGKSTLIGRLLHDTRQIYEDQLSTLQNESKKIGTQGEKLDLALLVDGLAAEREQGITIDVAYRYFSTAKRKFIIADTPGHAQYTRNMATGASTSTLSILLIDARKGVQEQTRRHSFISTLLGIRHLVVAINKMDLLDYQQEIFESIQQDYLHFAQQLPRDLTIEFVPISALEGENVVSPSLNMPWYTGKTLLALLEDAPVKFKLGAKSQRLRFPVQYVNRPDLDFRGYSGTVSSGSLYQGQQIKVLPSGQRSTIKRIVTFDGDLTQAQVGQAITLLLADEIDISRGDIIVDANDTTANVSNHALVDIVWMSEQPLVQGQTLDIKVAGKKSRAKIENIHYQVDVDKLTQQVTESLALNAIGHVEVLFEEPLVLDNYQLNAQTGGLIFIDRLSNVTVGAGLIREIRDNVQPTTSQYDAFEIELNQLIRRHFPHWGARDLLGGK

SEQ ID NO: 7088 - protein, 427 aa, Proteus mirabilis
HDEGEGRTIMIKATDRKLVVGLEIGTAKVATLVGEILPDGVVNIIGVGSCPSRGMDKGGVNDLESVVKCVQRAVDQAELMADCQISSVYLALSGKHISCQNEIGMVPISEEEVTQDDVDSVVHTAKSVKVKDEHRVLHVIPQEYAIDYQEGIKNPVGLSGVRMQAKVHLITCHNDMAKNIVKAVERCGLKVDQLIFAGLASSFAVLTEDERELGVCVVDMGGGTMDIAIYTGGALRHTRVIPYAGNVVTSDIAYAFGTPPNDAEAIKVRHGCALGSLVGKDENVEVPSVGGRPPRSLQRQTLAEVIEPRYTELLNLVNEEILSVQEQLRQQGIKHHLAAGIVLTGGAAQIDGLVECAQRVFHTQVRIGKPLNITGLTDYAQDPFYSTAVGLLHYGKESYFGEETETEKRSAVSGWLKKLTGWLKREF

SEQ ID NO: 7089 - protein, 379 aa, Proteus mirabilis
KGEGSMNSESPIKHVRWAIMCSVIGFALTGCADTPYRPAPITSVNDSSSNRTVSTSPVTTNSNAGVATPIERGSTPLQTTPPPSIRVNNTTAQPQSQPRTQNVTPQNVNTDGSGRIVYNRNYDNIPKGNYSGNTYTVKRGDTMFYIAWITDSDVKDLASMNNIPEPYSLNVGQVLKIGNRQVNTGTNTNVNTSVINKPSSEGVQTAQTKPSNNNSSMGPLITKPTTTTPPKTTTSTPTTSATTSNNTTATSKPAAATGKWVWPAQGKIIESYSNAPGGNKGIDISGTRGSPIVATAAGKVVYAGSALRGYGNLVIIKHNDEYLSAYAHNDTILVREQQNVNAGQQIATMGSTGTSSVRLHFEIRYKEKSLNPMSYLPKR

SEQ ID NO: 7090 - protein, 76 aa, Proteus mirabilis
IPRGGDQMKTIKLNVGHLSTLEEVEHINEELQALLIPLLTAVENEAETDTHFMLRAVNRLVCAQGKEITRLVEVMK

SEQ ID NO: 7091 - protein, 248 aa, Proteus mirabilis
SAGGDMSRLSLSQLVLLSIEEQRLALDEINQQLEQKTAIERVIWALEHLPNQFVLSSSFGIQAAVCLHLLTRQYPDIPVILTDTGYLFPETYQFIDELTSSLQLNLKVYRAEISSSWQEARYGKLWLQGIEGIERYNQINKVAPMERALKELQAKTWFAGLRRQQSKSREHLPVLSIAKGIFKLLPIVDWDNKQIYQYLKQHNLPYHPLWEQGYLSVGDTHTTRKWQEGMSEEETRFFGLKRECGLHE

SEQ ID NO: 7092 - protein, 360 aa, Proteus mirabilis
SKGGAMKPVCVLGNGQLGRMLRQAGEPLGIAVYPVGLDAEPEAVPYQKSIITAEIERWPETALTNELEHHANFINRDIFPLLADRLPQKQLLDELHLATAPWQPLTSAEQWPELFNQLGEFIIVKRRVGGYDGRGQWRIHPGDEQQLPAEIYGECIVEQGIPFSGEVSLVGARNRQGDCVFYPLTHNLHQDGILRMSVALPNPPEALQQLAEDMLSKILNKLNYIGVMAMECFIVGDKLLINELAPRVHNSGHWTQNGASISQFELHLRAILDLPMPKPNVCQSAVMVNLIGTEIDIKWLSLPLVHLHWYEKEVRPARKVGHLNLVHNNHQALQKSLSTLSPLLDEAYQYPIKWALEKLS

SEQ ID NO: 7093 - protein, 210 aa, Proteus mirabilis
YFMGLDIVMFKDQFTPQQKMDICTFEEGDPTENPWVKGKPAQIHIEIVPHNPNWLIQFNEQKLLIQNALSDIALSIEHIGSTAVAGLAAKPIIDIDLIIENPKDESSYIPQLEALGYELIIREPSWYQHRMLKLSNPMVNLHVFGKNCPEHWRHLLFKQWLTTHPDDLANYATIKQFAKHNVKTTQDYNLKKQSLVRAIYQKIFTSLIGD

SEQ ID NO: 7094 - protein, 266 aa, Proteus mirabilis
PSKGIEMKKVLKWVLIILVVLIIIGIFAGKDKDGSDKKPEAVKSSEQKIAMTDKEYKMAELIINNDVMNSLNGNDSQITTDYIRVTAREMQQTYASNEARGDKTYKGKNIIITGIIKSIDSSIGDIPVVSLNTGEMFSTVRLHLAKPYRDMAADLDKNQKITLACVGDSVIIGSPGLKDCKPVPAVASKITNEQMKFVNKFIKGNNEVPNEIKQIVLLAKVLGKETGDFSQCQDINSQCMNDSVKVLKSISKEKLQEEAKLLGVEM

SEQ ID NO: 7095 - protein, 90 aa, Proteus mirabilis
YYGGYSYSKDNHNLYYGVSGSVVAHSQGVVFGQQLGETAAIVDIPNAGDITILNQAGVRTNNSPYALIPYVTPYRKNTGRDRYIKSAREC

SEQ ID NO: 7096 - protein, 64 aa, Proteus mirabilis
IEGGSMSKPIPLDRAAYKAQQNNSLLAVILELASKDCSRELIDLVSIAYDFNAEICESLEEATK

SEQ ID NO: 7097 - protein, 115 aa, Proteus mirabilis
GKGGYMRKLLFICLFTVILSGCEKNQTLDGSNVESLRISIVEMRNSLPLEEQQRFDEAIELAMLNDINFNDLVIAGRNKNADMITRKMCQSLDGKTVNEIFSQAEEIKVQKLALK

SEQ ID NO: 7098 - protein, 62 aa, Proteus mirabilis
LGFIARRLFIYARFIVMSVPLIGRLTGFIGVFVLMSYFTVIFNCHRFHSAHAGKTPYEVLKE

SEQ ID NO: 7099 - protein, 143 aa, Proteus mirabilis
RTIIMSKSNLIAFRLPAELQTLFNEAVSNSGSDKTAWIVSAIKEKLNRPDSNPDARILSLVERLESSVASLIAGKADIPPYTYNESAVVSVVNSVLSEGVTNGRIIAEQINEAGYQTKAGKAWDKDIYSAWKRHKDITDKLVS

SEQ ID NO: 7100 - protein, 312 aa, Proteus mirabilis
KEIINVRKRIIMKTIVIALGGNALLQRGEVLSAENQYKNIELMSETINKLAQEYRVVLVHGNGPQVGLLALQNLAYQAVPAYPLDILVAESQGMIGYMMMQKINQNNPTQAITTVMTRVSVDINDEAFREPSKFIGPIYEEAEKEELIIKYQWTFKKDGQYYRRVVPSPAPQKIIDIEAVKLLLDKGHIVICGGGGGIPVNNINNEFIGSEAVIDKDLTAALISRELNVEHFVILTEADAIYKNWGTPEQAAIREATPEELAPMAVADGAMGPKIMAVSDFVNATGQQAHIGALQNIQQVIEGQSGTLIYKS

SEQ ID NO: 7101 - protein, 586 aa, Proteus mirabilis
HVVIRGMFIKMKSQTQAPLVVEGKLSDSERMKKESNFLRGTISDDLQNGLTGGFEGDNFLLIRFHGMYQQDDRDIRAERAQQLLEPRHAMMLRCRLPGGVITPKQWLSIDKFASENTLYGSIRITNRQTFQFHGILKGHVKPAHQMLASTGLDALATANDVNRNVLCTSNPEQSSLHQEAYEWAKKLSEHLLPRTHAYAEIWLDKEKVATTDEEPILGETYLPRKFKTSVVIPPYNDVDLHANDMNFIAIAENGHLVGFNVLVGGGLAMTHGDKKTFPRLASEFGYIPIDKTLAVAEAIVTTQRDWGNRTERKNAKTKYTLERVGIETFKQEVERRSGVMFDMIRPYQFTHRGDQIGWLKGVDNKWYLTLFIESGRLIDKPNAPLKTGVAEIAKVHLGDFRLTANQNLIVAGVPEAQKEQIEAIARQYGLINDEVTPLRKHAMACVSFPTCPLAMAEAERFLPAFTDTLDNIMAKYGVSDEHIVVRVTGCPNGCGRAMLAEVGLVGKAPDRYNLHLGGNRMGTRIPRMYRENISSQEIIEILDTLIGQWAISRELNEGFGDFLIRTDVIKPVVNSAIDFYEVQEVI

SEQ ID NO: 7102 - protein, 81 aa, Proteus mirabilis
FIAIFIINYFEGLDCCMDSEDVWFYFLMCYFHEHYSELISVIFIISFIGIIWGIIHEMRWLSVFFTLPLLIFVVGLIFSNS

SEQ ID NO: 7103 - protein, 75 aa, Proteus mirabilis
IIYIKMRGRQKILPFQLQNKNSNGEIPLGNGKNLYIAVNGKPLVTVPLRTRAFSKLGNATPGTVSAKITATLIYQ

SEQ ID NO: 7104 - protein, 120 aa, Proteus mirabilis
ISYMSDNNIFFDMVLSFEAIMNKKISKIVGARIKMLRQQHGMTGSELGALLGVSQQHQSRFENGECNIHVDVIYLLSYIFKVKLNYFFQDINDCFDQEGIAYKESYYHSETIVEKCELWR

SEQ ID NO: 7105 - protein, 277 aa, Proteus mirabilis
PILLFECCAGVNEFTMSQAALNNKEIKEKRHSDRPSNGSYLSGLIFFLCVIATIIWGGIQVVNWMKDANRLPISKLVLTGERHYTTNDDVRQAILSLGQPGTFMTQDVNIIQQQIERMPWIRQVTVRKQWPDELKIHLVEYVPFTRWNDTHFLDREGRIFSLPTRLETQGNYPLLYGPQGSEKMVLAGYLAMRDQLLASNLKLKAASMSARQGWQLVLDNDVRLELGRKDTEKRIARFIELYPILQQQTDKRVDYVDLRYDSGGAVGWAPLLLDVNE

SEQ ID NO: 7106 - protein, 148 aa, Proteus mirabilis
TFHITIILWSMKNETNIRRGRHCVFLMHIHLVFITKYRRKIFDQDAIEKLRGYFASVCADFDVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 7107 - protein, 425 aa, Proteus mirabilis
NLHICGGIIGGIIPFNENWCPQMKLTARQVETSKPKEKAYKLSDGGGMYLEVAPNGSKYWRMKYRYAGKEKRLALGVYPSISLAQARAKREEAKRILALGDDPSLVKKAEKREKESQVNNSFEKITLEWHDYKKPNWSKGYADDLLEAFQKDIFPYIGKVSITEIKPLDMLEVLRKLEKRGVLDKLKKIRQACNQVFRYAIVTGRAEYNPASELAGALSTPKAKHFPHLNVNELPEFLQALSVCSGSKITQIATKLLMITGVRTIELRAAEWSEIDFDKAIWEIPKERMKMRRPHMVPLSTQALELFKEIQTITGKFKYIFHGRNDASKPMSEAAINQVIKRIGYDGRATGHGFRHTMSTILHEQGYNSAWIETQLAHVDKNSIRGTYNHAQYIDGRREMLQWYADYMDTLENGDNVVHGNFKRA

SEQ ID NO: 7108 - protein, 256 aa, Proteus mirabilis
FMIFEASLVALWAFFCGIDKYDVALNIHRPLITGPVVGLIMGDMQVGLIAGATLELAWLGLVPNAGAQPPDVTLGTIAAVAFAVMTKQSPEVAMGIGMPIAVLMQMLVIGFFAMTAFTMGKADRYAEKADGAGISRLLIITLIVRSLLYALVAFVTVYFGEHAAQWIDENTPKVLLEGLGIGAKMVPAIGFAMLLKIMWSKEVAGVFFIGFVMTTYLKLPIMAVAILGASAAALYFFFSGNNKNSSQQNEDFEDGI

SEQ ID NO: 7109 - protein, 657 aa, Proteus mirabilis
VSNMKISKVCISLILYLGYAALLYAENNNLDDIYFDPDFLELPNKDIIDLSSFENNQQLAGDYYVDIYVNTNLILTKNIRFDKDKNNQLKPCLSVNDLNDFGVKTTDYPGLYSEYTSCVNLSAIPEAKSELDFDSQRLYLSIPQIALSKNPRGYIELDNIDNGINALLLNYSYSGSKNYDRKNGSSNTTSNYINLRPGLNLGPWRLRNYTTWSSTSNQSGKWNTLYTYLSRNINKIKSQLILGDGISSSDVFDSVPFRGMQLSTDDEMYPESLRGYAPIIRGIAKSNSQITIKQNGYTIYQTEVAAGPFEINDLYPSGSSGDLYVTIKGANGSEQHQIVPFASLPVLQREGHFTYSVTGGEYRAYDNNVDKTKFGQFTLVYGLPYGTTAYGGSQLSQNYQSYSLGVGKNLGSFGAVSVDVTQAKSTFNDGRKQQGQSYRFRYNKNLNNIGTNIALAGYRYSTSGFYSLSEVFDSFRRTHYSPEIEQRRHRAEITLNQNLGDKYGSLAIGYIQEDYWNSKSKKQSATLGYNNSWQGISYGINYTYNKNTVNHSYIADQKRQNDDEHLLAFSVNVPFSVFDNTFYYNFNANSNNNSSSTGSVGISASQLNNRLNWSVQQAFTNQDQGSSGNINASYKGQLGDITGGTVIAKIIIIFTMV

SEQ ID NO: 7110 - protein, 201 aa, Proteus mirabilis
STNIVNGLLIKYRLRIIMQWRNTSTRYGHLSLLLHWGTALTVYGMFALGLWMVNLGYYDSWYHSAPEIHKSIGIILFIVLLFRAIWRWISPPPTALSSYSRLTRISAHVAHMLLYLILFAIIISGYLISTADGQPISVFDWFSVPAVFTGEGEQADLAGDVHLYLAWAVVVLSLLHAAGALKHHFIDKDITLKRMLGIKTQ

SEQ ID NO: 7111 - protein, 331 aa, Proteus mirabilis
KYNIVNKNSGLSSGEIMKVWSLGDAVVDLIPLQNMQYEACAGGAPVNVAAGVAKLGQQSGFIGRVGEDAFGHFMQKTLFDLGVDTSTMEFDELHRTSTVLVSLQENGERDFTFLVADSADQFLTNKSLPVFEKDILHFCSLALVNPICRSTLDSAISKVKNSDSLLSFDINLRPQMWRDHEEMRAIIDEYAHKADILKLSEDELTWMTQEITLENALKKLADYPARLKVITQGSKGCLVLTPTTQVALSAFTVNCVDTTGAGDAFMSGLLAAVAEYGFADDEQYLLKIITQAAACGALATTKKGAIAAAPSRKVLREFVNKQPPLHVRDIF

SEQ ID NO: 7112 - protein, 1025 aa, Proteus mirabilis
GENIMPIFRFTALAMTLGLLSTPYHVIAATSNPAFDPNHLMQSEIYHFAQSDPLADFSSDKNSTLTLSDKRSIMGNQSLLWQWKGGSSFTLHKKLIVPTDKEASKAWGRASTPVLSFWLYNEKPIDGYLTVDLGEKLNATSEAQAGFKVKLNFTGWRAIGISLNNDLENREMTLNATNTSSDGTQDSIGRSLGANVDSIRFKAPSNISQGEIYIDRIMFSIDDARYQWSDYQIKTRLSEPEIEFHTVQPQLPVTPENLAAIDLIRQRLINEFVGGEKETNLALEENISKLKTDFEALNIRPLSDGGMQGRHLITDKQTIIYQPEQLNSQDKQLFDNYVILGNYTTLMFNISRAYVLEKDPTQKEQLKQMYLLMTKHLLDQGFVKGSALVTTHHWGYSSRWWYISTLLMADALKEANLQTDVYDSLLWYSREFKSSFDMKVGANSSDLDYFNTLSRQHLALLLLEPDDQKRINLVNSFSHYITGALTQVPPGSKDGLRPDGTAWRHEGNYPGYSFPAFKNASQLIYLLRETPFAVGESGWNNLKKAMISAWIYSNPEVGLPLAGRHPFNSPSLQSIAQGYYWLAMSAQPAPDKQLASIYLAISGKSRNESPTIFGEEITPASLPQGFYAFNGGAFGIHRWQDKMVTLKAYNTNVWSSEIYNKDNRYGRYQSHGVAQIVRNGSQLSQGYQQEGWDWNRMPGATTIHLPLKELDSPNPHTLMQRGERGFSGTSALEGKYGMMAFDLLYPANLARFDANFTAKKTVLAADNHLIFVGSNINSSDKDHPVETTLFQHAITPELNTIWINGQKIEGFPYQTTLKQGDWIIDSNGNGYLITQAEKVNVSRQHQTSAENKNRQPTQGNFSSAWIDHGIQPKDHSYEYMVFLDATPEKMAQLAEKFRANNGLYQVIRKDKDVHIIYDKLSQITGYAFYQPAVIDDKWIKKVDKPSIVMTHQEGNILTVSAVTPDLNMTRQKAATPVTINVTVKGKWQPTAQDSEVKYNVSGDNTELIFTSYFGIPQEIKLSPLS

SEQ ID NO: 7113 - protein, 167 aa, Proteus mirabilis
DLNMVTFHTNYGDIVIKTFADKAPATVENFLDYCKEGFYDNTIFHRVINGFMIQGGGFEPGMKQKETKAPVRNEANNGLANNRGTLAMARTNDPHSATAQFFINVADNDFLNFRAENANGWGYCVFAEVVEGMDVVDKIKAVSTGRSGFHQDVPREDIIINSVTVSE

SEQ ID NO: 7114 - protein, 145 aa, Proteus mirabilis
LMNIDWVHFTPWSSALGGLLIGLAAAILLLFNGRIAGISGILGGVLTTNQQGNGWRWAFLLGMLITPTLFYLFDKPLTPIIDVSPWQLIIAGVLVGAGTRLGNGCTSGHGICGLARLSRRSIVAVLVFMVTAFVTVYIQRHVIGG

SEQ ID NO: 7115 - protein, 199 aa, Proteus mirabilis
VMNISNINAFEHSEQGVILITEAANQEAISYTEALEALNDGSFDGDLIFGFELVLAICKGECDGFFNPTNQQRVILWRWIVAASFVAEQADNNGTHQVDNGGGKTITAAIYRNKHAALTVYAASERMLLANHIEGAAYEHYGAENGAIMAVKIYRDFINLEPKRGCRLSERGREGLSVLHDDLIRAIEDGEFSDTVTIH

SEQ ID NO: 7116 - protein, 330 aa, Proteus mirabilis
VADMIILFDSFSAYDSKVSLTLLVESHMWAQSGVLLAICSYILWGITPLFYRLLPGAQPLELLAQRLIWSIPLLLLVRLFIKNRTRWRAVLQDRRSIFMCLFSSLAMAVSWCTFTYALTHQQVLAASLGYFINPLFSIVLGVIFLKEKLNPAEKWAVILICAGVGYQLWMYGQLPILALVMGGAFAIYGLIRKFIRFDVITSLFIETLWLIPVAIGAMIWLIMRDESAFSSADNLTRFYYILTAPVTILPLLFFTAAIKRTTLTVIGLAQYIEPTMQFLLAVFLFHEAFDAVKGVSFSLIWLGLLCCIFALIRKRLNALKIHKGQHSQKI

SEQ ID NO: 7117 - protein, 476 aa, Proteus mirabilis
DTRMDYLPLFVELKQRPVLLVGGGHVAARKAVLLLKAGARLRVIAPQLCDELHLAYQQNQIEWIAGQYQAEHLLGMMLVIVATDDKVLNQQVYLDAQARHIFVNVVDSQPQCSFIFPAIIDRNPILIAISSAGKAPVLVRMIREKLEALLPTSLGTMATIAGKWRNKVKQKLTGFQARCRFWEQAFSGKFASLVASGQLIQAQAQLEQQLSHPDSPQGELALVGAGPGDAGLLTLRGLQVIQQAEVVLYDSLVSADILELVRRDADRICVGKRAGQHSTLQEEINQLIVKYTQLGKRVVRLKGGDPFIFGRGGEELEIAVQHGIPFQVVPGVTAASGASAYAGIPLTHRNYAQSVTFMTGHCQSGGIEPDWQALAQANHTLAIYMGTTKAELISQRLIEQGRSPLTPIAVISCATCHDQQILTGNLTQLAQLAKQAPTPALLIVGEVAALHHQLAWFGDRQTQHTSAIHSSLVHFA

SEQ ID NO: 7118 - protein, 816 aa, Proteus mirabilis
GGVMIWRWFWREWRSPALLIVWLSLALAVACVLALGRIGDRIDKSIYAQSRDLIAGDLVLRASYPVDENWLAEAKRMGLTLSRQMQFTTMSYAPEGDTPQLALVKAADNLYPLYGELETQPAGLKAEKGTALVDARLLALLGIKVGDNIDVGDATFTISGVLVQEPDSGFNPFQIAPRILINLADVEATGAVQPGSRLTYRYMFAGNEALIDEYQQRFDPLLKPDQRWNSLKQDNGALSQSMERAKNFLLLSALLTLLLAISAVAVSMTHYCRSRHTLIAVLKTLGADNHALRKWIIGQWGVIIVAAIVVGSLVGWGFELVLLQILAPVLPKSLPDASFMPWLWSVGSLLLIALLTGLRPYHQLMSTQPSRVLRSGTTAPSWPLRYYLPIVALIVVGALTLFAGTGVLLWSILLGIVVIAFLLGVIGWLGLWLLKQFKFKQLSARLAVTRLLRQPFQTMTQLAAFSLSFMLLTLLVLLQGDLLEKWQQQLPEDSPNYFLINMSKPQVQQINTLLATYHVAPTDAYPVVLARLTAINDHNAKVWADARDAGNNTVRRELNLTWHSELPKDNVIVEGSWPPVGNGVSIDQGVAQKLEIKLGDELTFVGDTREFKSVVTSIRHVDWENMRPNFFFIFAEEGLSNQPEKWMSSFYYNGDGSLITALNRQFPTVSVLDTGALIQQVQQILQQVSRALEIMVGLVMLCGALLLVAQIQVGMTQRRIELVVYRTLGASKSLLRRTLWAEFALLGLMAGLAAAIGAEVALGLLQKSVFNFPWQPQWMMWIVVPALAAVLLSLCGSILGVRLLQDKGQYRRIQGE

SEQ ID NO: 7119 - protein, 63 aa, Proteus mirabilis
STPILKLSSFQYPLMVKQNFTILFNHHKRGSQEKTQNISLIGIYSTPVIHICSFYSHVSSTDR

SEQ ID NO: 7120 - protein, 65 aa, Proteus mirabilis
GIAMLQREAIEVVMMELAHQQGQSLNGRDRLAIRTGVAQTIQAKERHRRRMTAPTYQWTKPAPKR

SEQ ID NO: 7121 - protein, 315 aa, Proteus mirabilis
RSYIMDSINNEILWIFIGLFSFLIIASIIGAILAALKGPTSTITNLNSRIKAWWIMCIISAVAISIGTIGSVILFALISWLALRELVTLTPTHRGDHEALFWCFFVVLPIQYILVGVQWYNLLAIFIPVYAFLLIPTRMALSGDTHHFLERMAKVQWSVMIAIYCLSYAPALLMLPIEGFEGRNINLLLFLMIVVQTSDVLQYVFGKLFGKHPIVPKLSPNKTIEGFFGGIISASLIGMMLWWATPFTWWAAFLLSLVITLAGFAGGLCMSAIKRDSGVKDFGTMIEGHGGMMDRMDSLCFAAPIFFHVIRYFYV

SEQ ID NO: 7122 - protein, 236 aa, Proteus mirabilis
LSNIMAPLFPITSLIHSIHSSRITMRQSIVDTLSVLKVIPVIQINRAEDAIWLGELLTQNQLPIAEITFRTPAAAKAIKLMREHFPELILCAGTVLTAQQADIAKEAGASFVISPGYNPKTVDYCLHNGIDIVPGINNPSQIEVALERGLTLLKFFPAEASGGVKMLKAMAAPYSQVQFMPTGGISLNNVSDYLAIGQVIACGGSWIATTEAIDNQDKQTIARNIQNIHSLLKNKG

SEQ ID NO: 7123 - protein, 287 aa, Proteus mirabilis
EANMYLVSTRNMLNKAQHENYAVPAFNIHNLETIQVVMETAAEMASPVILAGTPSTFAYAGSDYLISICQQAAEQYRIPVALHLDHHENIPDICNKVISGVRSAMIDASHFPFEENIRLVKEVVNFCHYWDCTVEAELGRLGGQEDDLIVDAKDALFTDPDSAVQFIKATGIDSLAVAIGTAHGMYKHEPHLDFDRLHAIRQKTEIPLVLHGASGIPDTDVRHCIDLGICKVNVATELKIAFSNAIKQYFLDNPDASDPRHYLVPGKAAMKAVVADKIRVCKSDGKL

SEQ ID NO: 7124 - protein, 316 aa, Proteus mirabilis
GTSMRRRVATITLNPAYDLVGLSTPIELGEVNRVTTAGFHAAGKGINVAKVLKSLGIDVTVGGFLGKENQDGFQKEFSEAGIANRFQMVEGRTRINVKLTEPSGKVTDFNFSGFEITKQDWTRFVNDTLSWAGQFDMICVSGSVPPSIDLNDFTAWMKRLRSECMCLIFDSSREAFVAGLKALPWLVKPNHHELEIWAGRPLPELSDVVQAAHELRQQGIAHVVISLGEQGAMWVNASGAWMAKPPKCDVVSTVGAGDSMVGGLIYGLMMRQTSEHTLRLATAISALAVSQTNVGITDREQLARMMTEVELTPLKI

SEQ ID NO: 7125 - protein, 62 aa, Proteus mirabilis
PFLIFLILIFFKSIKWFFVSNSQGEATTDPYTLILTVLLNAIGEYENNKNNVSDFHITPSFY

SEQ ID NO: 7126 - protein, 264 aa, Proteus mirabilis
GCLMAKKPTYSVRFVAGQPVERIEPSLPLGQIEEMLPIGMPLYTEGTLKIAVWNIYKQQRVNWRSMLETLATDTQLLLLQEAQTTPELVRFAGKNHLIADQVPALAFQQHPAGVMTLSSSHPIYCCPLREKEPFLRLAKSALITVYPLITGEHLMVINVHAINFSFGVDVYQRQLNSLSTHIIDHKGPVILAGDFNAWSRPRVNVLKRFARRLKLKEVIFEKDLRTRAFGKPLDYIFYRGLSLNKAEILITDASDHNPLVATFS

SEQ ID NO: 7127 - protein, 286 aa, Proteus mirabilis
  UNSURE (81): Identity of amino acid at the above locations are unknown.
TKLILRVISFILDCDEKKNHLAFIGNSVIHYRTNNMLLKKIFLVSFLFPTLSYANTLPTSNIDISLLPNHDNLARFSLGDXSQASGSGATAIGINSQATNTRAVAIGYGALANEENTVSFGNSEEKQTARLTNVSEGKNNTDAVNLAQTKALLSKNKRLTDSQINVFRNQTNNNLNTIKKTIHEFDDYYRRRQASITDAIEALDKKVISLEKKVYAGIASSIAMTNIPYLTHHTFSGGLGISNYRTGIALAGGIQYQPNNDIAFRFNSSINSEQELIFGGGLAYGW

SEQ ID NO: 7128 - protein, 178 aa, Proteus mirabilis
RRLMSIINFWRQFGRRYFWSHLLLGMVAAGIGMPSLVSAHAENPSQTDTPSSQNRQSQALIAFDNLFLRQSVQNPASSFTFNYWQQHAVKNVIKQLSFAFTIHSPELMVKAKDEPSPVANVAEVMLDTLYALLTQAPSSTLVNLPISRGVLTENRISYHTGLWLAQIRGIRAGPYLTA

SEQ ID NO: 7129 - protein, 731 aa, Proteus mirabilis
NHIIVIRLYLMKNKNLLFLSAAVLSAIYGSAVAADCDSTLTICETVNINNGDTAQINKDVNVSQGDGVVFNGSSTEYKAQAITKNITVTGNGANAIKINQGATFSSNINLNGANVTSENGTAILVEGNFPKRGTGVYIRDGAIIRGKTAAIDFSTLKTGFRSDVNGEIHGDILGNNHVDTKINFAYQGGAQNALFDGYKITGVPLIENHGNLTIQGKDKTIQWEGNFMNKENSQLIFRLDDNTNTDETILHVTGDVTFKKGSQAKLDFKGTSVDNIINKDIVLIASDSAIKDEAGITVTDANAIAPDISPLLEKTDSWLETTPPNISGGVSGNQLIARYGISYEGGDNFISAAERGNVTENGLAAANFIIPTVLNEFNNTRSQISDEALSLLVAAGNNDNNIAALSNDLAPIADGSDIQAGLIMVEDMRNNIAHRYLRYDNQLPIEEREIGWNSWANILYGYGTQSQQGGINGYNTYRTGIQIGTDYEINQDALIGVSLAYNYAKADAKQRNASKEISHFEFMPYAGWYSDTLFLNGNLNIGYYTVDSERDIGGNTGWQGNTKAKGDYSGVQLGYQINAGTYLDFDFIHIKPMLTYQYQWLNIDSWEETGSTLSMRTYGQRYAVNQLGGSVALWNDYQTSYGKLTPSLNLRYIKDIAGNNDINQRHSLTYFNTGGSTFDIKGNTVGGDIISAELGANLDITQSLNLGTTMGYQRYDKFNEGRIGFTVSQRF

SEQ ID NO: 7130 - protein, 387 aa, Proteus mirabilis
RDIMTTHLFTSESVSEGHPDKIADQISDAVLDAILEQDPKARVACETYVKTGMVMVGGEITTKAWVDIEEITRKTVREIGYTSSDMGFDANSCAVISAIGKQSPDINQGVDRADPLEQGAGDQGLMFGYATNETDVLMPAPITYAHRLVQRQAQVRKNGTLPWLRPDAKSQITFQYDNNNIVGIDAVVLSTQHAEDISQKDLHEAVMEEIIKPILPTEWLNEQTKYFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKIPTSQLILLVREFFDLRPYGLIQMLDLLHPIYQKTAAYGHFGRAEFPWEATDKAEILREAAGLK

SEQ ID NO: 7131 - protein, 134 aa, Proteus mirabilis
GGIMEKKNHLSQVASQDNVASSILSKNPPKKHRARLYMLGTGINGFTENEILIHCRLSSGRNYPNELERLLNIELERIDEPNPDGIGSHYRYRFKTAQDVQKVINLINKRAEQGNYQPIDNALINNILSLYPTK

SEQ ID NO: 7132 - protein, 67 aa, Proteus mirabilis
LSIILPCAGHTHLPVAAAGLEVAVVLLLVVAEVVGVEVVVFGGVVVVGFVINGPIELLLFDGLVCAV

SEQ ID NO: 7133 - protein, 163 aa, Proteus mirabilis
VGIIMTPAVNLLEKQKIKFTLHPYEHDANVHNFGDEAVEKLGLDNRQVFKTLLVALNGDAKNLAVAVTPVSSQLDLKRVAKCLKAKKAEMADPQIAQKVTGYLVGGISPLGQKKRLPTVIDDQALKFDTIYVSGGKRGLDIELTAEDLCSVLGAQFALIRKED

SEQ ID NO: 7134 - protein, 64 aa, Proteus mirabilis
GEVMANKEIVLSLEVPRMKINRVLTLLTVWQEANQDEETAHMIAIAFAAVNDALKDIDSAMEGK

SEQ ID NO: 7135 - protein, 522 aa, Proteus mirabilis
EEAMTVSRRTFIKGLAASGAAISVSTPALATSGDFTASKRTRPENAPNLLIVFPDEMRAHALQFMGEDPSITPNLNKFAKQAKVMTQMASNYPLCSPFRGMFMTGQYPVRNGITGNAHDYGGKVGIDLSPYAKCWSDVLKSLDYSTGYIGKWHLDAPYEPFIESYNNPMEGRYWNEWAAPDRRHGFDFWYSYGTYDLHLKPMYWANDTPRDKPIYIDQWGPEHEADMAIKFLKNENNQFRDNSKQFALVVSMNPPHSPYDQVPKKYLDAYQGKTSKELNTRPNVQWDSEYQEGYGPQYFKEYMAMVNGVDEQFGRIVDELEKQGLADNTLVVFFSDHGSCLGSNGQATKNNPYEESMRVPMMFRLPGKIKPGFDDALMSARDIYPTILGLLGLSEWIPDSVEGTDLADRVITGKGDTANSQLYLFIPYGEPSFGKRGVRTKTHTLVIDRQDGQPLKYTLYDNVNDPYQMKNIAKDNMPLIDKLIKEELTPWLEKTGDSWRATEFITATTNKLNKKISICEEK

SEQ ID NO: 7136 - protein, 116 aa, Proteus mirabilis
GKQMPYKIVRYQDRNQKVPYREWIQKLRKRDPQAAAKIEVQVTRACYGNFADHKFVRDGVWALRINFGQGYRVYYSIENEFIILLLVGGNKSTQQADIDKAVNYLEDYHVRMKNDQ

SEQ ID NO: 7137 - protein, 572 aa, Proteus mirabilis
VIKMNKTKTTRLSFLHYWHGLGAWNFYFLLKFVLLWYGYLKFDAFSNLLFLAFLLFPLPKTFWHKLRNWIALPIGVMLFYHDTWLPSFSTVLEQGGQLKNFSFSYLIELAVNFINLKMIGVAFILLVGYLFIEQWVRVSVFIIAGVVWLNISGFTHFSGAMASAVSANSFTQQTNTSIDQPQQQNTEILSTAQTRAQNNNVLSSPYPPQKQPANNKVLDEWLAQFYRYENKRSTPAPAQLSSYAQPFDILIINICSLSTADAAAVGLQQHPIWGNFDVLFNRFNSVASYSGPASLRLLRASCGQTQHADLYDPADMQCLLMDNLATLGFEKKLVLDHNGEFGHYLQEIRELGNLNVPLQDQRGLSHQITAFDGSKIYNDKETLERWLKAREKSDEKRTVTFVNLVSLHDGNRFVGENTTADYGKRASALLDNLNAFINTLDKRGRKVMVVIVPEHGAALQGDTTQMSGLRDIPSRSITTVPVGIRFTGLKNQRLPHTPMMIDKPSSYLALSDFILRNVNGDIFNQPTIDWNTLTRELPQTATVSENQNTIVVDYQGKSYIKLNEGEWIDYPD

SEQ ID NO: 7138 - protein, 136 aa, Proteus mirabilis
GNKIMSENNLSPNEKPLLSNEDKIHLEHLLEKIRPLLALKRLDNIVDLLSLASDTVDIMDNATVEKLAVAFEETLIPVWELTTAFNMAKKESLYQDKKYTLGATFSLLKNPDTLKGLTIVLRTLQIIGENNQKIEV

SEQ ID NO: 7139 - protein, 120 aa, Proteus mirabilis
ESKMIKVMRLFLLITTIGISFFSSAGSTVTLQFSGNIKAATCNVSGSKNINIDLKQMPESLFNKVNSSSVWNDFNIKLIDCSPGVNQVKLTFSGTPDNADVNNLYKNEGTAKNIAVSITK

SEQ ID NO: 7140 - protein, 329 aa, Proteus mirabilis
VIKMNHLMGKRLFLLGTIFFFSADAFAACIQNPNLKNIQARIPNKTYSIQYDDIGTRVLDEFQINYANGPIKTYLDKNGDCGDASLSGYYTNGWIPDNNKVVKTNIPGIGMKIKLNSLGFINLTWSKVEPPNSPYRIINPSWTVQIIKTGRVTQSGSLQWGKIAQAVQNNTQPKNTTWNLTSLYLPLNAIKINSLKCTTKSSNYNINMGTWYDTQFKNIGDVSKSVDVPITLNCAAGTNIKATVTSSAGYIDANTGKLNLSGTNRATGVAIQLLDKNNNPIKLNTKNSLQNGVSSGDYIFGWKARYIKTGNKITPGSANSTATVNILYE

SEQ ID NO: 7141 - protein, 402 aa, Proteus mirabilis
GSKMTILGTALTTNATKVMLLGAGELGKEVIIECQRLGIETIAVDRYANAPAMHVAHRHYVVNMLDSEALKQIITQEKPDFLVPEIEAIATSLLVELENNGQKVVPCARAVKLTMDREGIRRLAAETLHLLTSPYQFVDDEAAFRKAAVEIGFPCIVKPVMSSSGKGQSVIRSEQDLTSAWTYSQEGGRAGQGRVIVEKMIPFDFEITLLTIRAIDGIHFCEPIGHRQEKGDYRASWQPQKMSDIALAKAQHIASKVVENLGGYGLFGVELFIQGDEVFFNEVSPRPHDTGLVTLISQDLSEFALHVRAFLGYPIGGIRQLGACASAVILPELSSTNIVYTGLEKALKANRQIRLFAKPEISGHRRLGVVLAHADSIKHAIEEANLGAQAILADDGDNHLSR

SEQ ID NO: 7142 - protein, 494 aa, Proteus mirabilis
DTKMVIEIASKPRPKLPYEHPDVKIYQRLFKENIIRRLVRKSAYHRHDNAIADFFKDETHSLFSLCERLTQYITEAFHHYQVWGYSHAYYPGSPGQQTVRTDALEGVSRVLPLLAAWTVNSKKSTLLGLNQQIYHLPSMIKQSFIHGTDPLHKGYWGKLENYDQRICEASDLALTLWISREWVWDTLSSEIKQQIINWFEQVNHCEIVDNNWHFFPLTVQFVIKALTGKDTIAHWRYERLKEFYVGDGWFRDGAKGNYDYYNAWGFYYSLYWLAQIDPQFDHDFITQSLNNFNQHYLYFITPKGIPFFGRSACYRLAVSAPLLAGVDLQCPFVKVGEAKRAFESSLRYFISQGALKNGAPTQGLFNHDARLVDNYSGPASSFWSLRAVIIALYCADRINLWQAPSLPLPIEKNDFRFEIPAIQASIIGVKATQEVSVIFREDYTQQQSPLTRRLEKQTRVQKITETVIGQSRRPKNNLLRKGVTSYSSKMTHFF

SEQ ID NO: 7143 - protein, 61 aa, Proteus mirabilis
LIEIGRFWGISAKVKAVNQNSDLTFAELSHKAVDNLVQKPVYDLRITLNNLYHLLLKPRFT

SEQ ID NO: 7144 - protein, 355 aa, Proteus mirabilis
NGEIWFAIRLGLSFIYYLIIFHAAMHPLKPHLTYFDQIKKLEKRGMSFEDLPPEQAVKKIMNIGYYRLSGYWYPFRKLKLIPPVAPDEARREETFLEGTTFTTVYAHYLFDVKLRSSIFYGIERIETYLKAKIAYELGKVSPTAYKDKNIIQYRHHYRHDTWLEKLDSLIERNSDKDCIRWNLDKYGDIPIWAIVDIWDFGTMSRFYGMLEDKYKHQICKSLGFLKPNSANVRDGLKTALEHLNTVRNRCAHHARLWNTDFSDSKISIDVLDNIDLTASRLSPKSPELSRMAGIIFLIWSLTKRISCNSTWLSSVNDHLEKHQGVIPFNSMGFDNNNISGLKNLLDKEKEQSAQS

SEQ ID NO: 7145 - protein, 1011 aa, Proteus mirabilis
EKTFSRKQVIPYYAIIEVIAFYLEILTMAKTTLLALQGLSCSHCVNSVKKSLDARNDIEQSTVTIQYAKIDSDATVESLIKTIEEAGYEAHLATQADVKLNLSGLNCMKCVGKTENALLAVDGVVAVNVDKTSAEIFGTANAKDLIAAVVAEGFEASLANEEENKPKTIELTLSGLNCGHCINSVKKALEGTDGVESAQVELTHATVTGTANTESVITAIQNAGYDAKLAGANHPKTEPLTQTDAPLEASSAAICDIPVEEAILDNNNADISIDDDSTQLLIDGMTCASCVSKVQKALQSVSGVENARVNLAERSALVTGHVNHDDLINAVEKAGYGAEIIQDDVKRRERQQEVAVANMKRFRWQAALALVVGIPVMVWGMIGDNMMLTEANHNIWLTIGIITLVVMIAAGGHFYRNAWQSLKNGSATMDTLVALGTGAAWLYSISVNLWPEVFPAQARHLYYEASAMIIGLINLGHMLEQRARQRSSKALERLLDLTPPTARVVTDNGEVECPLADVKQGMILRLATGDKVPVDGEITQGEVWMDEAMLTGEPIPQQKSLGDTIHAGTTVQDGSVLFKAAAVGSQTTLARIIKLVRQAQSSKPEIGQLADKISSVFVPIVVVIALIAGAIWYFFGPSPQITYALVIITTVLIIACPCALGLATPMSIISGVGRAAEYGVLVRDADALQQASQLDTLVFDKTGTLTEGMPQVTEIHTFNQISETQALALAGALESGSNHPLAKAILTKAEGIKLPQISQFRTLAGMGLSGEIDGNIVLLGNPKLMKESGIDISEINALIENQSAKGVTPVLLAQNGKIAALLSIRDPLREDTVSALQRLHHQGYRLVMLTGDNPITANAIAKEAGIDQVIAGVMPEGKAQAISQLQAEGRRVAMIGDGINDAPALAKADVGIAMGGGSDIAIETAAITLMRHSLHGVADAVEISKGTLRNMKQNLFGAFIYNSLGIPIAAGILYPFTGTLLNPVVAGAAMALSSITVVSNANRLLRFKPKK

SEQ ID NO: 7146 - protein, 257 aa, Proteus mirabilis
GILMLKILVSNDDGVMAKGIQTLAKALRQRYDVQIVAPDRNRSAASNSLTIDRPLRKQRHENGDIAIVEGTPTDCVYLGVNHLVRPRPDIVVSGINHGPNLGDDVLYSGTVAAATEGRFLGLPAIAVSLDGETHFDTAAQVTCDVLAMLQRVPLRAGNILNINVPDIPLAEIKGFRITRCGSRHASQHVYTQTDPKGNTLYWIGPPGEKNDVGPDTDFAAVDAGYVSITPLHVDSTAYKALELLKDWLNKAEVEKTC

SEQ ID NO: 7147 - protein, 332 aa, Proteus mirabilis
EQLMSQSTLRVDELYTDDIDENMEEFDEAAATKEAENESDAQDEIELIEGVNQRALDATQLYLGEIGYSPLLSAEEEVFFARRALRGDIPSRQRMIESNLRLVVKISRRYTNRGLALLDLIEEGNLGLIRAVEKFDPEKGFRFSTYATWWIRQTIERAIMNQTRTIRLPIHIVKELNVYLRTARELAHKLDHEPSVEEIAQTLDKPVDDVSKMLRLNERISSVDTPIGGDSDKALLDIISDENEEGPEATIQNNNLKENIVKWLFELNPKQREVLARRFGLLGYEAETLEDVGREIGLTRERVRQIQVEGLRRLKDILQGQGLCIEALFKMN

SEQ ID NO: 7148 - protein, 92 aa, Proteus mirabilis
TWLIEINGTDHLTFRSLVQRCSITGRNCYSPFAVEINECCTTKHPHFPQRYNLHHIIPQIPTNRVYGWYENVVKPVVGRFIDIYSNFIISSK

SEQ ID NO: 7149 - protein, 275 aa, Proteus mirabilis
IIMITWLLLALSLLLLGFHRKLALTTLAITTISAFITGVITWYVLPVILSLILLSCAYRHYKTNRLIATIVILAFIAIIVGLTFHFIPGFNNLRYIKHVPLGQYSPPFSFYFNADKALIPFILMIFIPTLFKTEPVKKANKYQWVLLAMAIPALLLFAMALGGLAIELHLPQWLPAFMLANIFFVSLAEEALFRGAIQQSLSRYLSPYLALFITAILFGLVHFAGGILLIIFASLAGIIYGLAWMWSGRLWVATLFHFALNLTHLLFFTYPFKIA

SEQ ID NO: 7150 - protein, 475 aa, Proteus mirabilis
MNVIPFPIHFNQFNIKISTNTGKVASQFFNCILIKYFSPVFCDKDQMDVHQEYTMSATANISFIFHRPKYNGNMKRLQAFTFQLRPNGQQEREMRRFAGSCRFVFNRALARQNENYEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYSNSREVVGEVRNVTVSQSCGKWYVSIQTEYEATEPQPESTSIVGLDAGVTKLATLSDGTVYPPVSSFKVNQRKLARLQRKLSRKIKFSANWQKQKRKIQRLHSHIANIRKDSLHKVTSEISKNHAMIVIEDLKVSNMSKSAKGTTERHGRNVKAKSGLNRSILEQGWYEMRRQLEYKQLWRGGQVLAIPPAYTSQKCACCGHTAKENRQSQSQFECLECGYTANADINGARNILAAGHAVLACEGRVQSDRPSKQELAEVIQTSV

SEQ ID NO: 7151 - protein, 505 aa, Proteus mirabilis
NLTILPLHWRLKMIKLNNVPSEFRPLESYKMLIGGEWVSSTSQQTTKTYSPATGELLSEYPSGTAEDVDLAVKAARKAFDHWRKTSPAQRQALLLKIADRLEQEQERFAWIESLDNGKPLNESKNIDLPASIDHFRYFAGVIRSHTDESAVLDENTLSLVIREPIGVVGQIIPWNFPLLMAAWKLAPAIAAGDTVVINPATLTSLSLLELGRILNEILPAGVINIVTGRGSVAGQAILEHQDIDKLAFTGSTNVGYTVAAAAAKKMVPATLELGGKSANIVFPDANMKKAVKYSALAILMNQGQACESGSRLFLHRDIHDAFLKELKAEFERIRVGDPLDPNTQMGTQVSQAQMDTILGYVELAKKEGATILTGGERITGEGFDDGFFVRPTIIINATNQMRVAREEIFGPVLCVIPFDNEEDVIEMANDSEYGLGGGVWTQDINRALRVAKAVRTGRMWVNTYHELPAHAPFGGYKKSGLGRETHKMMLDAYSQVKNIFISTKE

SEQ ID NO: 7152 - protein, 289 aa, Proteus mirabilis
ACQMNMKIKKILNNSVVISLDEAEKEIIVMGKGIAYAKKVGDEITSEQITKKFILSPKNCPQRVLDLLSNITLDYVEIADNIIQYAKEKMTLDTQDSIYIALIDHIQASIERYKEGTFIRNKILWEIKNFYSEEFDIGLYGLKLINDRFNISMPEDEAGFIALHIASIRTNDNIQQTYKVTHFIQSITNIVKYYLNIEYDIGSLNYRRFVTHLRYFSIRLFSQPENDHEPLENELLDIIKDKYHQPYMCCLKISKFIKDKYNCTLDDNEILYLIIHIAKIAEDNKKMNK

SEQ ID NO: 7153 - protein, 347 aa, Proteus mirabilis
RGEIEQMNEELIMKYSIGIGIALACFIAFLAISFLHDKQKKRRRNIIIHIIQAILLCSLVAIVSQYCEMAVVDFKLHFISFQMINFFSYLAIALILMRKFFLLINLLEKSQIKKGSDPTSARIISRIFKITLLVIMILLFGEHFGMSLSGLMTFGGLGGIAIGMASKDVMSNLFSGVMLYFDRPFNIGDWVRSPDRNIEGTVVEIGWRITKIMTFDHRPLYIPNSVFSSISVENPGRMTNRRIETELGLRYEDSDKVGVIVEDIRTMLQQNDKIDTKQTLLVYFNQFADSSLNIMVYCFTKTTVWAEWLDAQQEVYLKMIDIVHQHGADFAFPSQTVYIEKSSPVSP

SEQ ID NO: 7154 - protein, 434 aa, Proteus mirabilis
TFRILHPFYGVRMPVTQQNFGPIYQWSILILLGLVYFLATATTFTSLGVVLPSMIAELEWNWTQAGLGFTLLGLTCGLASFLPTLLIRKLNVRFTLLIGLIIFVSGFYFLYETNTITRYFLGTALLGVGFTLLATVPSTYVLSRLFEKQSFAFGVYFTIGGLGGVAGPWIYFLATHLWHTWRMHWLISAIILSIITLLTILVLREGSAEKAHAKKISQLQSSKRIYQTKAIWTARHALRTWQFYVIAATYTAFLWCGITVNSFAVAHIIENGFSETIAATLLSTMAFINAFSRLAGGAIGEWLEPKKLLIASLTIIIIGLLALSMANSWIYLMLFTLCVGIGYGMTFLASSVLLANYFGRAPYLELFSVMNLISTLACLAPFFAGAIKDISGSFTPAFLILTIPVLVILVITLFMRPPIYPNFQHASEKHNAPR

SEQ ID NO: 7155 - protein, 279 aa, Proteus mirabilis
QRYFFMIYADLHVHTNHSDGVCEIKDVLENAFRNGIKTIAITDHDTTNHYDEIYREGERLGLNIVKGVEMSCYDFDVYKKVHVVGLWLNEKTPNVDKLCDNTLNCRDQFHRELILSLNQQGYDICYEDAKKFSKYNIVFKMNIFQALREKYPEEMTKERYKQLFGSKTKIETDLKMGYIPVDEGIAAILQDGGIPILAHPCVYDNYDEIEKYVQFGLKGLEISHSRMKPIDYELTQNYANKFGLLKSGGSDFHDPALLKFGDFGLNQTQFETLKKDANK

SEQ ID NO: 7156 - protein, 213 aa, Proteus mirabilis
YSHFCNSIITENLMNKFTQHTGIPVPLDAANVDTDAIIPKQFLQKVTRTGFGKHLFHDWRFLDDEGTQPNPSFILNQPIYQDASILLARENFGCGSSREHAPWALTDYGFHAVIAPSFADIFYGNSFNNQLLPIKLSDEQVTQLFDWVTEHAGTPITVDLVAQQVIAGELCFSFEIDAFRRHCMIEGLDSIGLTLQHQAEISAYEAKQPAFMR

SEQ ID NO: 7157 - protein, 228 aa, Proteus mirabilis
YFFVKKMNNEEKNRRPIKARQTNWATRCSRWLQSKGATPNGISLFSILFAAISGLFLYFALAHSQGLLQSILLILGALAIQGRLICNLLDGMVAVEGGLKSPAGAVYNELPDRIADTLIIIGVGYGLSITFPIAITLGWVAAFFAVMTAYIRVLGGSCGLEQRFTGPMAKQHRMALLTGIAIISAFIPAEWGAWLCLVSLWIIIFGSVLTTILRTRQILRDLTQGVDE

SEQ ID NO: 7158 - protein, 286 aa, Proteus mirabilis
SRFVITRSSGGNMQIQALQTSQHIFAFEGEFKCVGIYEHALNFICPQQRLITFHRQGRGLSPMGWLLKQADFDSLAKQCHPALKMRMKNNQIAIADNMTLIAGDSENLRLQDKATLDLRWLESFFSLLSPVIATGLYGPLKNYRQIARLDEIKLLTKLFYHQLSGKAVNWAMFIGKGPGLTPSSDDMLVGMLFAHYLAEPEKSIEHFFNETPPLSSLTTIVSQHYLEYATRGIFSTYLIQLGKKIKNKEIIFKDMLEILSIGHHSGADTLLGLWIGYQIKQQQRID

SEQ ID NO: 7159 - protein, 244 aa, Proteus mirabilis
YCFVIYPLKRNNFMKKVLLSLTMLAIISTPVLAKSPVANLKINGDIKPPTCTINGATQSDVLFDYGRISPSLIPQSKIYSYSGIVAHNVVTVECDAKTYLTFVASDTYGDTELSVNNTSEWFHLVDKANPENTVGAADFIWSDATVDGKPAFISRANDVAITGKSYNNVLYKGPTNGWTSEQQSGVDKNALALIPGEVFQSNFRHGNSNGTFILSKDELSKKGIDLSNGLDFIGEAVLTFNFGV

SEQ ID NO: 7160 - protein, 210 aa, Proteus mirabilis
LMNFKNLFRRHTCFLIVMMMFSFKSIAADTFLIFGDSLSAGYRLPIESAWAQRLADKWKLTYPEINVVNASISGETAFQGQNRLPDLLKQHQPRWVLIELGANDGLQGYPVAQTKEALQNIITQVKEAGATPLFMQIMISPNYGKRYTQSFSAIYPQLAKDNALELIPFYMEQIADKPEWMQNDSIHPNEAAQPFIAQWMDKTLSPYLTR

SEQ ID NO: 7161 - protein, 326 aa, Proteus mirabilis
WETVKINRTVAIIGECMIELSGQPFLPQQQRFGGDTLNTALYLARLIPTLHPQYITGLGTDNYSALMQKAWEKEGINCQSVITIPEKLPGLYAIEIDTCGERSFHYWRSDAAARYIATDNRFATHLDTLPDDSVIYLSGISLAILTPKGKEALITQLIRLKQRGSTLIVDSNYRPRLWDLIPHAQEWFEKLYRLSDIALVTGDDEQALWQQPSLTEQKIVERLHQWGNKNVIVKLGAKGAFWSDGENTGYICPKPIQHVIDTTAAGDSFNAGFIAAWLQNYPLPTCCLWGNTLAGLVIQHHGAIIPHNITDSFYSLIKDNHETVNC

SEQ ID NO: 7162 - protein, 156 aa, Proteus mirabilis; identical to SEQ ID NO: 5578

SEQ ID NO: 7163 - protein, 362 aa, Proteus mirabilis
SGGVINQRVFILMSDLPELHWLHGKPTATGRLKSTPEDFKVSEDLGFTLDGEGEHVMVRVRKTGCNTAFVAEKLAKFAGIHPRDASYAGLKDRNAVTEQWFCLRMPGKEMPDFSQFTLEGCEILTTTRQQRKLRIGTLKGNHFTLVLRDISDVTSVETRLVEIQKQGVPNYFGVQRFGRNGDNLRQAWRWATNEIRVKERSKRSFYLSAARSAMFNHLVSQRLERHIYTQVLCGDAMQLHGKRSWFVAEEAELAQTQTRYEEHDIHITAPLPGKGDLGTQAQALIFETDNLADYEALWSLAQQERVDTTRRAINLLPENMSWHWLDDTTVSLSFFLPAGSFATSVVRELILLGNIDAENISE

SEQ ID NO: 7164 - protein, 169 aa, Proteus mirabilis
KEGVMWKSLTLFLLFSYSPIALSNTVNINVYGSVVASPCELETKNHLIDLKKINIRNIKNGQASDWIDFSIKLKNCPVNTEKVTMILRGQSVPNYSEYFINSGTAKDIALNLAMQNNKGIVKNNDKLMTAVNKYNHNAEFALSARMVGYGNNITVGSFKSHLEFTLIYN

SEQ ID NO: 7165 - protein, 77 aa, Proteus mirabilis
CLYVITFCHSLVAYLLRRWLMRNPQPNDFYTHKNNSETVKVLSVQFNRVTFQRDGFDSPVIVPLSQFSNEYTYAGRA

SEQ ID NO: 7166 - protein, 555 aa, Proteus mirabilis
TMSLSFKLSACALTVTLAMAPVMSQAWEKDKTYQITILHTNDHHGHFWHNDHGEYGLAAQKTVVDNIRDEVAKNGGSVLLLSGGDINTGVPESDLQDAEPDFKGMNLVGYDAMALGNHEFDNPLEVLRQQEKWATFPFLSANIYQKSTGERLFKPYTIFDKQGVKIAVLGLTTDDTVRIGNPANFPDTEFRKPADEAKKVVEELRTTEKPDIIIAATHMGHYDDGNHGSNAPGDVEMARALPKGYLDMIVGGHSQDPVCMSQENKNYKQADYVPGTPCAPDNQNGTWIVQAHEWGKYVGRADFEFRNGEFTLKHYQLIPINLNKKVKKEDGTTERVYYTEEIPHNPEMMKLLTPYQEKGGEQLNVKVGEVVGKLEGDRSKVRFEQTNMARLLLSAQAERANADFAIMSGGGVRDSIESGDITYKDVLKVQPFANELVYVDFKGEEVEPYLSAVACMKVDSGAYAQFYNVSLTVDADCKVSDVKIAGKPLDKTKNYRMATLNFNGIGGDGYPKIDSHPGYVNTGFVDAEVLKGYIEKHSPLKAADFEPQGEIVYKK

SEQ ID NO: 7167 - protein, 226 aa, Proteus mirabilis
TQSVDPPPFSALGRKRLTGRKIVTIHQDIVWHPHQIGLKEREAQQVHKGCVLWFTGLSGSGKSTLADALEQTLYQYSTLHAPIRTYLLDGDNLRHGLCHDLGFSEQDRHENIRRVGEVAKLMVDAGLIVLTAFISPYQQDRQQVRERFAQGRFIEIFVDTPLALCEARDPKGLYQKARRGEIKQFSGIDSPYEPPTAPEIHLDGSLAINELTQQILAYLQQQQIYR

SEQ ID NO: 7168 - protein, 89 aa, Proteus mirabilis
MTPVLAGAGRIVSVTFLPVWSPTPVACTIRFNVRCLIIILSRNIIRPTNYYTYNWQDSLAQKAEMPIFLTINQPVFLRKQGYLNNLALC

SEQ ID NO: 7169 - protein, 642 aa, Proteus mirabilis
SKPVFKSCSDRAIPSYSLKKSNHNNSTDAVQCFFKAGSMSNQPPLLSMLPLTQEQLNKLQDVTKDLTPAQFAWLSGYFWGQFNQHSSTKDELVSVQSQVPQQETITVISASQTGNARRLAEQLRDKLVGNQLNVELYSASEYKFKQIHKTTTLIIITSTQGEGEPPEEAIAFYKYLHSKKAAPMKQTAYAVLSLGDSSYEHFCQAGKDFDHQLAQLGATSLLERLDADVDYQADADKWITQLTDILKIRVPEQNTQVLQQTQSGTTDSVDTARYHRDAPFSATLLTNQKITGRHSDKDIRHIEISLAGSELQYLPGDALGVWFKNSEEKVDELITLLWLTGDEQVNVKSQTLTLKEALLHHVELTQNSAPIIKAYAQLSRHEELLSLVADKSKLQQYAQTYPINEMVRQYSAQPNAQEFIDILRPLTPRLYSIASSQQEVDDEVHLTLGVVRYNVDQRAYTGGASGFLADQLQEGDTVNVFIERNDHFRLPEDNQVPVIMIGPGTGIAPFRGFMQQRESEGATGKNWLFFGNPHFVEDFLYQVEWQRYVKSGLLTRIDLAWSRDQADKIYVQDKLREQGQEIWQWLQQGAYLYVCGDASRMAKDVEQTLLEIVMTHGNKNIEQADDYLSELRLARRYQRDVY

SEQ ID NO: 7170 - protein, 569 aa, Proteus mirabilis
ICAVTYIKCVKDIIMIHAFIKKGSFQDSVSLMIISRKLSEAPEVEEISVMMGTPANKSLLDVTGFWHDIFNEATPNDICVSIKAESDDPAIIETISSALEEALADIANGQKSGNKLTTVRSWRTAKQKSPNANMLLISIAGEYAAELADTGLEDGCNVMLFSDNVSIADEKALKEKAAANGLIVMGPDCGTANIAGAPLAFANIAPKGSIGIVGASGTGIQEITSQIVLQRQGVSHAIGLGGRDLSEQIGGISAITAINMLAADPQTRVIAFVSKPPAPAVREKIIAEMKRHNKPIVAQFLGTTPEKYQDDNIYFTRTLDETARIAATLARVEDSAAQLPKVTGKKIIGLYAGGTLAAECAMLLSEQLNVAVDNEHKQGTMLDAQGHKIIDMGDDFYTQGKPHPMIDPSTRNKFISELSNKHDIGVLLVDFVIGYGATSDPAGALIQEIKKLNEKRGEANPLITIATITGTQEDPQNRSEQQKQLQDAGIIVMDTLPEVVLLAKELIQPHPVEAAAEISPLLNGISVINAGLRSFADDLQSSGTPVVHYQWAPVAGGNKKLAEILKKLK

SEQ ID NO: 7171 - protein, 125 aa, Proteus mirabilis
VKRVLMITTIFKDFQFEAAHHLPHVPKGHKCGRLHGHSFLVRLEITGEVDAQSGWLIDFADVKAAFKPTLDRLDHYYLNDIEGLENPTSEVLAKWIWQQVKPSLPLLSAVMVKETCTAGCIYRGE

SEQ ID NO: 7172 - protein, 110 aa, Proteus mirabilis
PTLVEPVNASLSMSWCSRIACPATDPRPVTIFITPAGNISFKIRPSSNNESEVSVAGLITTVSPAAMAGANFQAAINNGKFHGIICPTTPMGSRITRLRVFSSKTALSSV

SEQ ID NO: 7173 - protein, 369 aa, Proteus mirabilis
WWLVSSIILWRTRMEHANTEALQRDLVLQNMKRVYRYQSAHQVRSVRRRSGKTRFIKDTDWERGVLWTCVSAAWQATQDKEYLNGVLNYTLHTGFRTGPNARFADDHVCAQAYLAISPLFEQSEILEPTIKAFDIMLNDPKPGREDWWWCDALFMAPPGFAALAEIISERRYLDYMHTAYWDAIEHLRDAETGLIFRDHRYIPDGQGNEMREANGEKVFWSRGIGWVLASIPRILQYMPDDYHERDRYITLFKQLARSILDYQHEDGFWRTSLLDPDNFPAPESSATALFCYGLAWGINQGELNKEEYFPALHRAWSALQSCIHDNGMIGWVQLPAFNPREVKFEHNMDYGAGAYLLAGSEVLKMTLNN

SEQ ID NO: 7174 - protein, 334 aa, Proteus mirabilis
CRVVLIHHSLSIILIYMLLVKISNRGNGMKNCTLGNETDNSLISNAFGFLRFPLNFQPYSSDADWVITGVPFDMATSGRAGTRHGPGAIRQISTNLAWEGHRWPWHFDMRERLKVVDCGDLVFNFGDAQDMSDKLQAHTEKLLAAGKRCLTFGGDHFVTLPLLRAHAKHFGKMALVHFDAHTDTYANGSKFDHGTMFYHAPNEGLIDPQHSVQIGIRTEHDTNNGFTVLDAAQVNDRGVDDLVAQIKEIVGSLPVYLTFDIDCLDPAFAPGTGTPVVGGLTTDKALKMLRALQPLNIVGMDLVEVSPAYDQSDITALAGATIALDMLYLQAAKK

SEQ ID NO: 7175 - protein, 769 aa, Proteus mirabilis
DLWVIIMKKYFLLFALLMLSGLAYSDDEKEVPAVITEQPFITVEEEKITLTSPDQIIPSRQETRLFATTAPTYGALKLQGASPDGYLEFGVRSDEYVSQAILDLEFTPSPSLLPIESHLNIYLNDEIMGVIPLKKEDLGHKNHITLPLDPRFIQDFNHLKFTFIGHYREICENQANTTLWLDISKNSQLHLTYQSLKLSNELANFPEPFFDSRDFGTFTLPMVFSQSPNLTQQKAAGILASWFGTQVDWRQQHYPVYYNQLPNQHSIVFATNKQRPDFLNTHANVNAPTIELVSHPTDPYVKLLLVMGRDDNDLITAVNGIARGQVIFRGDTVTINDVNLLAPREPYDAPKWVQLNKPIYFNTLQDYQGQLQSRGLEPAPITLNMTLPPDLFMFNNTGLQMQLRYRYTAPAFQDDSRMSISVNDHFIKAYPLERDKKENFIVAYLPLIQGWIENKNLLNIPAVKLGERNQIRFSFDYTNPIPGGSVDQCITYHPVPNTVALDELSSFNFTGNYRHYIALPDLRVYSHAGFPFSRYADLSETLIYVNQSPSPEQLTTLLISLGNIGAQTGYPALNVSLTASLEELSKQEADLLLIGTIPPALNNDKQMNVLIDKARSEITLPSREITIFSHTNYQDLDKRPDSRTSLTSTGSLGTIIGFQSPFFSQRSVVALLADSPQGYRLLNEAISDSGKRDAMHGSVVLVRESGVHSLRVGDTYFVGYLPWWEEVWYVFASHPIWLGLAAIVGIVLISLLIWRAMKIRSQRRLADKE

SEQ ID NO: 7176 - protein, 843 aa, Proteus mirabilis
LRLLANMNRENMSGRSTSILATILFIIYSQNVYSVEFNLDVVDSKSKDNINFARFSEAGYILPGKYQLNLVLNGQGIGSSTYTVNVLERENKSQDENKKLLSQACLTGDIISSLGLKEKIENNLPTWNDGKCIDLLSLDGVEVTTKLNEGILSIKIPQIWLEYTSATWLPPSRWDDGISGLILDYNINTNVNIPHEGSNTQSIYYNGTVGYNFGSWRIRSDYQGNYNRTSGDAENNKDLLNFTRVYGYRAIRSLKSNLTIGENFINSNIFNSWRYTGISLESDDRMLSPQLRGYAPQVTGIAETNARVVVKHQGRILYDSTVPAGPFAIQDLDSSVRGKLDVEIIEQNGKTNKFQIDTAYVPYLTRPGQVRYKVVAGRSRDKLHNTEGPIFGTTEAAFGLSNAWTMYGGTIFAGDYNSVALGVGRDMFAFGAVSADITQSYARLPDRGTMQGKSWRVSYSKRFDNLDADVTFAGYRFNERNYMTMQNYLDARYRDDFTGKEKELYTVTFNKGLSEYNTSIGVQYNHQTYWDQSNSDYYSINLNKYMDVFAVKNISLNLSASRSKYYGKDNDVFFARVSIPLENNRGFINYDGSRNSGNYTHNIGYFNTTEDNLANYNLNVSTTYGDDMDSSSSFSGYYGRYTSIANINANATISNKNTSSFGFSANGGLTITAKGAALHPDGFNGGTRLLVDTEGVAGVPVDGGRVTTNNWGYGVVTDINSYYRNETTIDLTKLPNNIEATQAIVESSLTEGAIGYRKFEVLKGEKAFAIIRLADNSYPPFGSIISNAKGRELGIISDDGFAWLTGINPNEEIRVSWGAEQQCVAKLPNKIEPSNKILLLCEK

SEQ ID NO: 7177 - protein, 125 aa, Proteus mirabilis
IFLFKFINENKVSGNLHIRRWLFMNIDKNRGSDSLLLRKNIGNFIRESRIRKSLTGAQLGELLDVSQQQISRYENGITSINIETLDMILKLLDADWSEFYRKVLVVDIIKHKLKNSDSFPFYLRV

SEQ ID NO: 7178 - protein, 150 aa, Proteus mirabilis
LCIFNAMSSEAKIMTKLIAFISGLLFSAGLIIGGMSNPQKILAFLDIRGDWDPSLLFIMGAGLIVSAISYQIARHRQQSLLACPLAIPTKTVIDKPLVFGSILFGLGWGLAGICPGPGLVLAGGGFTQGVLFVSAMIVGWLIIGLIRKPQ

SEQ ID NO: 7179 - protein, 121 aa, Proteus mirabilis
INILLKSILIMEFTMTQRVQPDLLEAMKLAANEASSMLKTLGNGDRLLLLCQLSQGEKSVSELEESLGIRQPTLSQQLTVLRNEGLVNTRRDGKRIFYSIADEKVLVLLNTLYQLYCPIAG

SEQ ID NO: 7180 - protein, 86 aa, Proteus mirabilis
PYTFMYRVFSHVFSYHIKENTMNNLIRLSEVLRRTGYSKAWIYRLIKENDFPKQVKIGARSIAFVESEVDEWIANKIAESRSGEVA

SEQ ID NO: 7181 - protein, 1028 aa, Proteus mirabilis
RSAFAFLFYFAGNLIMLIKNSLAYAITLSFCLSLPAQALPSLSHEPFGDLYLFEDEMPNTLSTSNDHQLSLSKEHAKDGVQSLKWQYQPQSTLTLNNEVNYQDDKNTATPLTFMMWIYNEKPQSTPLTLQFKQNNQVALSFKTELNFTGWRGIAVPFRDMKGSATGKLDKLVITAPDQAGTLFFDQIIMSVPLDNRWPIPDYQIPYVNNAVNTMVSKNWSALLMYDQMFTAHYPTLNFATEFRDDQPEVASIYQRFEYYQGVSRDKKITAEMIDKNLALWKKLALEQHADGSITAKALDHPNRQNFIKVEGVFSEETQKALLDANMLRDVGKTLLQTAIYLRSRSLSAIDRKKLETLYLLGTRYVLEQGFTRGSGYQIITHVGYQTRELFDAWFIGRHILAKHNLLAPTQQAMMWYNATGRIFEKDNEIVDANVDILNTQLQWMIKSLLMLPDYQQRQQALAQLQSWLNKTILSSKGVAGGFKSDGSIFHHSQHYPAYAKDAFGGLAPSVYALSHSPFRLSSPAHARLKDVLLKMRIYTKETQIPLVLSGRHPTGLHKISIDPFKWMALAGTPDGKQELDTTLAAAYAKLANKDSFEGIKAENEPVGAWAMNYASMAIQRRASITAPQQSWLAIARGFSRYLVGNESYENNNRYGRYLQYGQLEIIPADLTKSGFSHAGWDWNRYPGTTTIHLPYDELEAKLSQLPSAGIEEMLLSTQRYSGANTLNNNSMFAMKLHGHSKYQQQSLRANKSYFLFDNRVIALGSGIENNDKQHTTETTLFQFAVPKLQSIIINGKKVNQLGTQLTLNNADTLIDPAGNLYKLAKGQTVEFSYQKQYSVDDRNSQQTEQLFATAVISHGKAPKNANYEYAIAIEAQDNKAPEYTVLQHNNQLHAVKDKITQEEGYAFFNATEVNSSQALLLSSDSPTMVMVKKQKQQLTLSIVNPDLNLYQGIEADQIDNKGNQVEVSVYSRQWLTADPQPISSTVTVKGIWKLATPQLGVNIRYQNNNTLITTTTIQAIPITVYLIK

SEQ ID NO: 7182 - protein, 65 aa, Proteus mirabilis
ISQFVSNKIKRGHNWGHDTKLNEIKMFIINIIRLYIESCRGHLKSTPYAIFKKICEICGSSNGSN

SEQ ID NO: 7183 - protein, 178 aa, Proteus mirabilis
QEQLIMIEWISAQPALFWLCLGVLLLIAEMLGTAGYLLWSGMAALCVALIAWILPIGWPIQGILFALLTVISAILWRIWLKRKKLSKEAENLNQKSHQLIGIKAVLLSDTENGFSRIKLADGSWRVYSDTPLKAGDTVKVIAIDGITLHVTSFSPTTRSASSTQHAAVIDDDNNQKDD

SEQ ID NO: 7184 - protein, 236 aa, Proteus mirabilis
NCKFLFNYHKGFLMKKIFMVAVISSLLVGCKVDLETKINTDNLLSSEQNIVKGDINFEVSSCNDFEDSRKESKSLIELKNKVPEIFRDAEYVECYKQKLNSFAHFSIPVGVGKVEDGQNTVDTDLMVFSYKEILAGVYASEGVIKRIKQAEKNSHQKMDFSISIILMPGNVKMDKVVALGVTFTGDTSKNDPVLISRIKFGNKPLTFKLSDVSVNQLMQYGMVPFLVTPEYFTLYK

SEQ ID NO: 7185 - protein, 66 aa, Proteus mirabilis
FYFSLSTKLGCVDNSIETPLDVNKQSLIWDDSAVIEDGSILVRIREIEEAQKAEKMQTERRGRKLG

SEQ ID NO: 7186 - protein, 321 aa, Proteus mirabilis
AKFSATYLLGSTMKYQDVTKTPCENAYFLVFNLINSSETRPTLIDFCNNLSGLLRSMRTRFPELDVSCVMGFGADAWSKLFPNQAKPRELNTFKQINGDVYTAVSTPGDLFFHIRALKVSACYELAAIISQKLNSIATSEDEVHGFRYFDGRSIIGFVDGTENPEFEDERVAYAVIGDEDPLFTGGSYAFVQKYIHDMAAWENQSLIEQEKVIGRHKFNDVELTDEEKDPGSHNVVTNIQDENGDDLKIVRANMPFSNPSKNEYGTYFIGYARYFSTTNRMLENMFAGTPEGHTDKLLKFSTPVTGTLFFVPSPAFLDDIE

SEQ ID NO: 7187 - protein, 919 aa, Proteus mirabilis
GGVSMKPIDVIREVKLKANGQWQAILSHLGAEVPLNTHTACPACGGKDRFRFDNKDDNGTFICNQCGSGDGLDLVQKILGGSVTEAAYEVANIIGIDTRSACPPAYRCSEIKAQQDELKAQQAEKQANEKREKHKRFIERYNRTIANVQRGGSDYLKAKGLHGFEMDLLQDGSLIIPLLDAGGVITGAQTIKPNGDKRLLSDSSKSGSYYPINETVNVSTVIIAEGLATALTCHLIQPEAHTVAAIDAGNLIHVAKVMRVKYPESKIIIAGDNDIKPDQDNTGKLAAEKAAKAVNGVAVLPPTDDKADWDDYRLSHGIEAARQAFNGQVDQQAGEIVEENNVIHIDAKKKVRPHDDLAPFFDKRHGGLYYIERKQNNTTGEIDEKETWFSDEMATVGIGSDGKDSYLVIEMKQEGSNRIIYEAIPRRELGSPQGWGRLRSRGVNITTKRGQLDLLANYLQRKGKRDEWTITHTAGWHDGAYVMPDGHIIGTPSRPVAFCGGTSAVAGYIVRGTAESWRKNVGNLMKGNQSMILGGLVALAAPLNSLSGGSSFGIHLFAQSSAGKTTTVEAASSIYGVPDELKLTWDATKYGLTIEAASRNDGFMPIDEIGQGNDVRHVAGSAYSLFNGTGRIQGNKDGGNKAVLRWAIVALSTGEEDFETYLIRNGVTPKAGQLVRLVSVPFTDTVEFHSLDDGDLHSRAIKRASTQHCGAVGRAWIEYLANNQDIANQKVTLKENEWLSSLPEEASPQVKRVATRFAMLDATAELSASITGWDSGECGRFIRNSFNEWLENYGTGNREKYQVVKRARDFIQRYGLNRFQPYTYGKRNGDLDRVYAGRITNLAGYLVSGRREDGKDEYHIIPSVFEDEILSGIQKKLGAEALEEAGMLVRPESGRVDGKTISINGSQQRFVVLIDSEEE

SEQ ID NO: 7188 - protein, 261 aa, Proteus mirabilis
FVELIVCLDINTIMNIPNSTFPIVAVIPAAGIGSRMQATCPKQYLKIGRLTILEHTINALLKHPRISQIIVAINPEDDYFYHLALAKDKRIIVVKGGGQRADSVLSGLRYITEHLAQNTWALVHDAARPCLSFSDLDNLIQLIDDNHLDPQFCGGILASPVRDTMKRSHQQDNHIEKTVARDTLWHALTPQFFPAALLKQNLENALAQNVPITDEASAMEFGGYEPLLVKGRADNIKVTQPEDLALAEFFLSRQITSIRNT

SEQ ID NO: 7189 - protein, 174 aa, Proteus mirabilis
VMSSQVGLNTSSPRIAIVMGSKSDWATMCHAAEVLDALQLPYHVEIVSAHRTPDKLFRFAEQAKENGFDVIIAGAGGAAHLPGMLAAKTLVPVLGVPVQSAALSGVDSLYSIVQMPKGIPVGTLAIGKAGAANAALLAAQILALHSADIFNALTQWRATQTQEVLNHPDPREAL

SEQ ID NO: 7190 - protein, 353 aa, Proteus mirabilis
FIYSSSLPKPKGFGKEAISMTMPTALCPNRMQVHSIHQETPEVWTLNLINHDFYRYKPGQFALVSINNSDETMRAYTLSSSPGLSPFVSLTVRRIDNGVGSTWLTSQVKPGDYLWLSDAQGEFTCADREGTRYLMLAAGCGVTPIMSMTRWLLNNQPKADITVIFNIREQSQFIFEKEWLELANAYPYNLNFIMMPKLPDDKGIFSGRISQEKLAALVPDIASRTVMCCGPNSYMEDTARFAKNLGVCAENIFMERFGDEPMCVDEAQQLTMTIRHPLKQINVPVGMTLLTAMEENSVPVLAACRAGVCGSCKTRIVKGDYEVTSTSTLTADEIAQGYVLACSCRLTGDVELA

SEQ ID NO: 7191 - protein, 415 aa, Proteus mirabilis
VIYSFDHISVIYKLIFSHFLTILVLCTKMADKRTLHYTNLGRKMNSKLSKPQSSEVDKGHFDDFYLKQNDEIDLFELFSVLYKSKFVIIGITLLFAIVGFTVASFLPQKWTSQAAITKPMLDEMKQLRATLNDLSLVDVDTGVNASSVYQKFINNYNSRVLREEYLVNTDYYKNLLAKMDDPTPLDKRKLIETIVTKDINLKASDSKNSDEEFSGEINLSFTAPTSEEAYDLLSGYIRFISTKVRVEVKDEIDDQIERKLNHAQKAYQMDLERIANARNVNVQRLKYALEIANAAGVKKPISSEGAQIKDDPDYSIAMGADALSSKLAITEAITDPTTVSSELKNRLYNIQQLEQIKLGDLQFVPFKYMLKPYEPTKKDAPKRALILVGAAFVGFILSVMGVLLGYMARNRRKTA

SEQ ID NO: 7192 - protein, 195 aa, Proteus mirabilis
RFNSYVKYKGKNMKLNKLAMFAIASMAFSATVAQAASGDGTITFTGKVIDAPCGIATESANQAIDFGQISKSLLEKDGISQVKQIPIKLVNCDLTKAGSDTGAAGSYKGVKVTFNGNTITGATEELATTGNTGTAIVISGTTTGSMVKFNEAGELQALGNNDNTLMYTAWAKKATNGTIAEGEFNATTNFTLAYE

SEQ ID NO: 7193 - protein, 200 aa, Proteus mirabilis
SCSSPSRSWWRDYLLRSLIREERMSRVAKAPVVIPAGVEVKLNGQVITIKGKNGELTRTIHNAVEIQHADNQLTFAPRDGYADAWAQAGTTRSLLNAMVVGVTEGFTKKLQLVGVGYRASVKGNTVNLSVGYSHPVEHQLPAGITAECPTQTEILLKGADKQVIGQVAAELRAYRRPEPYKGKGIRYADEVVRIKEAKKK

SEQ ID NO: 7194 - protein, 221 aa, Proteus mirabilis
YSGLFSRQIYLLTAMLFYITITAKYRHNIRMRSIMSHSTIRSYLHLSPSIAKDVYIDVTATVIGDVRLSEDVSIWPMVVIRGDVNYVSVGARTNIQDGSVLHVTHASENTPNGFPLIIGDDVTVGHKAMLHGCTIGNRVLVGMGSILLDGAIIEDNVLIGAGSLVPPGKRLESGFLYLGSPVKKIRPLTPAEIQHFIYSANNYVKWKNDYLSTAHSAIDKQ

SEQ ID NO: 7195 - protein, 87 aa, Proteus mirabilis
MNQSIQFPDREQWLEDQNSVLFPIMVNGMLFDCQITEQELKARFGDNSNGLCLFKQHRWEIEEEFEELAKLYEVSTLHPFYCLSMAE

SEQ ID NO: 7196 - protein, 72 aa, Proteus mirabilis; identical to SEQ ID NO: 5059

SEQ ID NO: 7197 - protein, 116 aa, Proteus mirabilis
SFTFIKNSWSSGLMQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 7198 - protein, 213 aa, Proteus mirabilis
EVETMIGLVGKKVGMTRIFTEDGVSIPVTVIEIENNRVTQVKDLEKDGYRAIQVTTGSKKANRVLKPEAGHFAKAGVEAGRLLREFRLNEGEEYTVGQSISVEIFADVKKVDVTGTSKGKGFAGTVKRWNFRTQDATHGNSLSHRVPGSIGQNQTPGRVFKGKKMAGQLGNEQVTVQSLEVVRVDAERNLLLVKGAVPGATGSDLIVKPAVKA

SEQ ID NO: 7199 - protein, 387 aa, Proteus mirabilis
CMDAREIWIRLNVVSRLPVNKAIKVVEYLQSLTQLNRKVLLECGLSEQQSHQFMRLQANCVKSTLKWLDKNESSLLTISDSDYPLLLKQISSPPLLLFVAGNKEHLKSTQIALIGSRDATQYGTKWATYFAQQLVKNKFTITSGLAQGIDGVGHRSALKHHGVTIAVLGSGLEQIYPSFHRRLAEQIKESGVLVSEHLPMAPPLARHFPQRNRIISGLSSALLIVEAGIKSGSLITANYALQQGKELFVLPGLLGDSHFEGNHQLLKQGANLASSPDDIMEYLNSSLQWLIFNHNDDLQDEHIAEVGSATNNKKESSNMPLEIEKLTPTQQQSINLILPLLGFDKAIPIDIIANKSGLSTSDLAPLLLELELIEKVAIVAGGYIRLE

SEQ ID NO: 7200 - protein, 205 aa, Proteus mirabilis
CAPANCVASNKQKEKNMNNEVSPVNNTIIEALQNNQVIAYPTEAVFGVGCDPDSESAVMALLELKQRAIEKGLILIADNYEQLKPYIDDNALTQEQRERMFASWPGPITWVIPAKSTTPKWLTGRFSSLAVRVTDHPIVKALCVAYGKPLVSTSANLSGLPPCRSVEEVKEQFRHRIAIVNGEVGGRKNPSEIRDALTGELYRQG

SEQ ID NO: 7201 - protein, 276 aa, Proteus mirabilis
RTMAIVKCKPTSPGRRHVVKVVNPELHKGKPYAPLLEKNSKSGGRNNNGRITTRHIGGGHKQAYRIVDFKRNKDGIPATVERLEYDPNRSANIALVLYADGERRYILAPKGLKAGDKVQSGVDAAIKTGNTLPMRNIPVGSTVHNVEMKPGKGGQLARSAGTYVQIVARDGAYVTIRLRSGEMRKIPSDCRATIGEVGNSEHMLRVLGKAGASRWRGIRPTVRGTAMNPVDHPHGGGEGRNFGKHPVTPWGVQTKGKKTRKNKRTEHFIVHRRTKK

SEQ ID NO: 7202 - protein, 285 aa, Proteus mirabilis
QVSYIDKDNDAMEKYVVMGNPIEHSQSPFIHQLFSKQSGIDYEYGRLLVPLGEFDKVATQFFSQGGRGANVTVPFKEDAFRFVDKLTQRAQACGAVNTILKLDDGTLLGDNTDGQGLILDLARLDFIIPGKILSVLVIGAGGATRGILLPLLNYNCDITLTNRTVEKAQQLAQEFSQFGTIRASAPQNVTDKHYDLIINASSSSMTDDIPPIPDSAYGFKTACYDLYYKAGMTSFLYHALKNGSTRLSDGLGMLVGQAAYAVELWYERVPDINPTINILRENLNK

SEQ ID NO: 7203 - protein, 215 aa, Proteus mirabilis
SLNQLSRRNVEEIGMELVMKDAQGALTVSETTFGRDFNEALVHQVVVAYAAGARQGTRAQKTRAEVSGSGKKPWRQKGTGRARSGSIKSPIWRSGGVSFAAKPQDHSQKVNKKMYRGALKSILSELVRQDRLIVVEKFSVEAPKTKLLAQKLKDMALEDVLIVTAEVDENLYLAARNLYKVDVRDAATIDPVSLIAFDKVVMTADAVKQVEEMLA

SEQ ID NO: 7204 - protein, 66 aa, Proteus mirabilis
RTCHVAKHSLTMAAVAVQLTTTLTMAHDLILLSKTLTCDLIHQRYLQVANSQGAYPEINHATPVRL

SEQ ID NO: 7205 - protein, 116 aa, Proteus mirabilis
SLWHLKYSKEQAMAAKIRREDEVIVLTGKDKGKRGKVKQVLSSGKVIVEGINLVKKHQKPVPALNQPGGIVEKEAAIQVSNVAIFNAATGKADRVGFRFEDGKKVRFFKSNKETIK

SEQ ID NO: 7206 - protein, 127 aa, Proteus mirabilis
RSTKMIQEQTMLNVADNSGARRVMCIKVLGGSHRRYADVGDIIKITIKEAIPRGKVKKGDVLKAVVVRTKKGVRRPDGSVIRFDSNACVLLNNNSEQVIGTRIFGPVTRELRNEKFMKIISLAPEVL

SEQ ID NO: 7207 - protein, 441 aa, Proteus mirabilis
QMAKQPGLDFQSAKGGIGELKRRLLFVLGALIVFRIGSFIPIPGIDATVLAKLLDQQKGTIIEMFNMFSGGALSRASIFALGIMPYISASIIIQLLSVVNPRLAEIKKEGEAGRRKISQYTRYGTLVLAIFQSIGIATGLPNMPGMQGLVINPGLPFYITAVVSLVTGTMFLMWLGEQITERGIGNGISIIIFAGIVAGLPPAIGQTIEQARQGELHFLLLLLVAVLVFAVTFFVVFVERGQRRIVVNYAKRQQGRRIYAAQSTHLPLKVNMAGVIPAIFASSIILFPGTITSWFGDGTGWGWLTTISLNLQPGQPIYVLLYAAAIIFFCFFYTALVFNPRETADNLKKSGAFVPGIRPGEQTAKYIDKVMTRLTLIGALYITFICLIPEFMRDAMKVPFYFGGTSLLIVVVVIMDFMAQVQTLLMSSQYESALKKANLKG

SEQ ID NO: 7208 - protein, 130 aa, Proteus mirabilis
TMAKAPIRARKRVRKQVSDGVAHIHASFNNTIVTITDRQGNALGWATAGGSGFRGSRKSTPFAAQVAAERCAEAVKEYGIKNLEVMVKGPGPGRESTIRALNAAGFRITNITDVTPIPHNGCRPPKKRRV

SEQ ID NO: 7209 - protein, 320 aa, Proteus mirabilis
QEKNVSDSLRIIFAGTPDFAARHLAALLSTQHHIVGVLTPPDKPAGRGKKLTINPVKELALTNNIPVYQPTSLKPEENHEWIKALQPDVMIVVAYGMILPKAVLDIPRLGCLNVHGSLLPKWRGAAPIQRALWAGDTETGVTIMQMDVGLDTGDMLYKASCPITHQDTSASLYAKLAELGPKALINTLDLIISGELKAEKQDDSLANYAEKLSKEEAKINWSLSAQQIERCIRAFNPWPMSFFMLDDQPVKVWEAQVIASDNTNQIPGTLLKADKTGIYIVTGEGILNITKLQPSGKKPMASADFLNSKRDWFTPGKIIQ

SEQ ID NO: 7210 - protein, 424 aa, Proteus mirabilis
FTMKTSYNLRSIAAKAIAQVLDQGLSLSSVIPELQKNISDKDKALLQELCFGTLRTLPQLEWIIQQLMDKPLKGKQRILHYLIMVGLYQLLYTRVPAHAALAETVNGAIALKKPQLKGLINGVLRQFQRQQDVLMERFQNNDSRYLHPSWLLTRIKNAYPELWESIIEGNNQKPPMWLRVNQIHHSREQYLALLEKEGISAFSDDHHPNAIRLETPCNVHLLPGFNEGWVTVQDRSAQRCAELLAPQNNEQILDLCAAPGGKTTHILEIAPKAHVLAIDIDEQRLARVKENLNRLKLHATVKSGDGRYPEQWCANMQFDRILLDAPCSATGVIRRHPDIKWLRRNEDIAQLAQIQKEILHAIWPYLKSGGTLVYATCSILPEENSQQIAAFLSSMQDAQCDYQHQCLPEQYSGDGFFYALINKK

SEQ ID NO: 7211 - protein, 166 aa, Proteus mirabilis
KDWKQRSIKMKGDKKMIAHLNKLLGGELVAINQYFLHARMFKNWGFTRLNAMEYHESIDEMKHADKYIERILFLEGIPNLQDLGKLNIGEDVEEMLRSDLELELGGAKDLREAIAYADSIHDYVSRDLMLEILTDEEGHIDWIETQLELIERIGLQNYLQAQMIEE

SEQ ID NO: 7212 - protein, 136 aa, Proteus mirabilis
GFTEKDKVMRHRKSGRQLNRNSSHRQAMFRNMAGSLVRHEIIKTTLPKAKELRRVVEPLITLAKTDSVANRRLAFARTRDNEVVAKLFTVLGPRFASRAGGYTRILKCGFRAGDNAPMAYIELVDRADSETEAAAE

SEQ ID NO: 7213 - protein, 145 aa, Proteus mirabilis
EMRLNTLSPAEGAKHAPKRVGRGIGSGLGKTGGRGHKGQKSRSGGGVRRGFEGGQMPLYRRLPKFGFTSRKSFVTAEIRLSDLAYVEGDVIDLNALKAANVVGPQIEFAKLILSGEVNRAVTIRGLRVTKGARAAIESAGGKIEE

SEQ ID NO: 7214 - protein, 61 aa, Proteus mirabilis
TKAEYGAVRYLECGRSLALMAQGSPWRASNSLARYQPGAVLETLSQNPALCPLFGAKPYLE

SEQ ID NO: 7215 - protein, 335 aa, Proteus mirabilis
HQREDTMQGSVTEFLKPRLVDIEQVSSTHAKVTLEPLERGFGHTLGNALRRILLSSMPGCAVTEVEIDGVLHEYSTKEGVQEDILEILLNLKGLAVKVHGKDEVILTLSKSGIGPVIAADIIHDGDVEIVKPQHVICHLTDENASINMRIKVQRGRGYVPASARIHSEEDERPIGRLLVDACYSPVERIAYTVEAARVEQRTDLDKLVIEMETNGTIDPEESIRRAATILAEQLEAFVDLRDVRQPEVKEEKPEFDPILLRPVDDLELTVRSANCLKAEAIHYIGDLVQRTEVELLKTPNLGKKSLTEIKDVLASRGLSLGMRLENWPPASIADE

SEQ ID NO: 7216 - protein, 89 aa, Proteus mirabilis
EGGCVMTDKIRTLQGRVVSDKMEKSVVVAIDRMVKHPLYGKFIRRTTKLHVHDENNECGMGDVVEIRQTRPISKTKSWALVRVVEKAVL

SEQ ID NO: 7217 - protein, 138 aa, Proteus mirabilis
SMYRIGQIAKLANVTTDTIRFYEKQGLMEHDRRTEGGYRLYTEQDLQRLRFIRYAKELGFTLDAITELLSIRVDPAHHTCVESKHIVDARLAEVEARLKEMEKMRDSLKMLSNACCGTAHESTYCSILEILESGATKQ

SEQ ID NO: 7218 - protein, 67 aa, Proteus mirabilis; identical to SEQ ID NO: 5360

SEQ ID NO: 7219 - protein, 93 aa, Proteus mirabilis
AMPRSLKKGPFIDLHLLKKVEKAVESGDKKPVKTWSRRSTIFPNMIGLTIAVHNGRQHVPVYVSDEMVGHKLGEFAPTRTYRGHAADKKAKKK

SEQ ID NO: 7220 - protein, 140 aa, Proteus mirabilis
GESLMLQPKRTKFRKVHKGRNRGLAIGTDVSFGTYGLKAVGRGRLTARQIEAARRAMTRAVKRQGKIWIRVFPDKPITEKPLEVRMGKGKGNVEYWVALIQPGKVLYEMDGVPEEVAREAFQLAAAKLPIKTTFVTKTVM

SEQ ID NO: 7221 - protein, 60 aa, Proteus mirabilis
TASRLNYCIFFLQSSVELAKLASPIIYNHTVLFEYPENGLFRIVLYKVNLGVHSGPYSRH

SEQ ID NO: 7222 - protein, 132 aa, Proteus mirabilis
RQMSMQDPIADMLTRIRNGQAANKVAVTMPSSKLKVAIANVLKEEGYIEDFKIEGDTKPELEITLKYFQGKAVVESIQRVSRPSLRIYKRKDELPQVMAGLGIAVVSTSKGVMTDRAARQAGLGGEIICYVA

SEQ ID NO: 7223 - protein, 212 aa, Proteus mirabilis
DSWRKKMARYLGPKLKLSRREGTDLFLKSGVRAIDTKCKLEQAPGQHGARKPRLSDYGVQLREKQKVRRIYGVLERQFRNYYKEATRLKGNTGENLLTLLEGRLDNVVYRMGFGATRAEARQMVSHKAIMVNGRVVNIASYQVSPNDVVSVREKSKKQSRIKAALELAEQREKPTWLEVDAAKMEGVFKRIPERTDLSADINEHLIVELYSK

SEQ ID NO: 7224 - protein, 66 aa, Proteus mirabilis
RNSGVMTMAKTIKITQTRSLIGRLPKHKATMAGLGLRRIGHTVEREDTPAVRGMINLVSYMVKVEE

SEQ ID NO: 7225 - protein, 104 aa, Proteus mirabilis
GDAGMIREERLLKVLRAPHVSEKASIAMEKSNTIVLKVAKDATKAEIKAAVQKLFEVEVESVNTLLMKGKVKRHGQRIGRRSDWKKAYVTLKEGQNLDFVGGAE

SEQ ID NO: 7226 - protein, 79 aa, Proteus mirabilis
TPQGVTGCLPKLRPSPPPCGWSTGFIAVPRTVGRIPRQRLAPALPRTRNMCSELPTSPIVARQSEGILRISPERRRIVT

SEQ ID NO: 7227 - protein, 70 aa, Proteus mirabilis
EVFMSSKYQHQKGVIKDNALAALVHDPLFRQRVEKNKKGKGSYMRKAKHNKKGNWEASDNKYFQLLSLAF

SEQ ID NO: 7228 - protein, 138 aa, Proteus mirabilis
GVVMAFFKEFREFAMKGNVVDMAVGVIIGAAFGKIVSSLVADVIMPPLGLLIGGIDFKQFSLVLREAHGDIPAVILNYGAFIQTVFDFAIVAFAIFCAIKLINKMRRQEEEQPKAPPAPSAEETLLTEIRDLLKNQQK

SEQ ID NO: 7229 - protein, 120 aa, Proteus mirabilis
GNTMDKKAARIRRATRARRKLQELGATRLVVHRTPRHIYAQVIAPNGSETLVAASTTEKAIIEQLKNTGNKEAAAVVGKIVAERALEKGIKSVSFDRSGFQYHGRVQALADAAREAGLQF

SEQ ID NO: 7230 - protein, 80 aa, Proteus mirabilis
CGSFAARGEENEVVIMYVCLCHGVSDKKIISTVHKHQIRTINQLRQILPVGSCCGKCIRQARQLIDDEQHLLYPQISEVA

SEQ ID NO: 7231 - protein, 273 aa, Proteus mirabilis
RRSFYEAHYASCKRPCRSYSEAHQPHHCGCVRSLRLWRLAMGQKVHPNGIRLGIVKPWNSTWYAGTNEFADNLDSDFKVRQYLTKELAKASVSRIVIERPAKSIRVTIHTARPGIVIGKKGEDVEKLRKNVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVLGVKVWIFKGEILGGMAAVEQAEKPAAQPKKQQRKGRK

SEQ ID NO: 7232 - protein, 188 aa, Proteus mirabilis
GKTMAKIMPFTHPSEQEKCPECGSDLIIRNGGHGPFLGCSAYPNCHYIKALKSQGDGQVIKVLEGQPCQCCGADLVLRQGKFGMFIGCSNYPACEHIEQIDKPDETVIHCPQCEKGKLLQRKSRFGKIFYACNQYPECQFVLNNKPINGECEYCHYPLLMEKRSSQGVRLVCASKLCGKQQTKREEHE

SEQ ID NO: 7233 - protein, 461 aa, Proteus mirabilis
ELTMKIIILGAGQVGGTLAENLVGENNDITVVDTDATRLRQLQDKFDLRVVNGHGSHPRVLREAGAEDADMLVAVTNSDETNMIACQVAYTLFNTPNKVARIRASEFVREADKLFLPEAIPIDYLISPEHLVIDYIYKLIQYPGALQVVNFAEGQVSIVAVKAYYGGSLVGNALSTLRDHMPHIDTRVAAIFRQDRPIRPQGSTIIEAGDEVFFVVASQHIRAVMSELQRLEKPYKRIMIVGGGNVGAGLAARLEKDYSVKLIEHNQQRATELAELLHDTIVFYGDASDQELLAEEHIEQIDVFIALTNDDEANIMSAMLAKRMGAKKAMVLIQRSAYVDLVQGGVIDIAISPQQATISALLGHVRKADIVSVSSLRRGVAEAIEAIAHGDENTSKVVGRRIQDIKLPPGTIIGAIVRNEDVIIANASHSIEQGDHVIMFITDKKYVPEVEKLFQPSPFFL

SEQ ID NO: 7234 - protein, 113 aa, Proteus mirabilis
EEEMETIAIHRHARSSAQKVRLVADLIRGKKVSQALETLTYTNKKAAGLVKKVLESAIANAEHNDGADIDDLKVAKIFVDEGPSMKRIMPRAKGRADRILKRTSHITVVVSDR

SEQ ID NO: 7235 - protein, 67 aa, Proteus mirabilis
DGDVMKAKELREKSVEELNTELLNLLREQFNLRMQAASGQLQQSHLLKQVRRNIARVKTLLTEKAGA

SEQ ID NO: 7236 - protein, 171 aa, Proteus mirabilis
GRSVRWLTSRNKLGELQEKLIAVNRVSKTVKGGRIFSFTALTVVGDGNGRVGFGYGKAREVPAAIQKAMEKARRNMKTVALNNGTLFHPIKGTHTGSRVFMQPAHEGTGIIAGGAMRAVLEVAGVRNVLAKTYGSTNPINVVRATLDALDSMKSPEMVAAKRGKSVEEILG

SEQ ID NO: 7237 - protein, 121 aa, Proteus mirabilis
ECIVARIAGINIPDHKHTVIALTSIYGIGKTRSQAICEATGIAENVKISELSEEQIDKLRDEVAKYVVEGDLRREVTLSIKRLMDLGTYRGLRHRRGLPVRGQRTKTNARTRKGPRKPIKK

SEQ ID NO: 7238 - protein, 172 aa, Proteus mirabilis
IMAVLHVLHYPDERLRTIAKPVEKVDAEIQKIVDDMFETMYLEEGIGLAATQVDIHQRIIVIDISETRDQKLVLINPELLDQEGDTGIEEGCLSIPEQRAFVPRAERVKVRALDYNGQPFELEADDLLAICIQHEMDHLVGKLFVDYLSPLKRQRIRQKVEKLDKRRAKAGQ

SEQ ID NO: 7239 - protein, 105 aa, Proteus mirabilis
GRAFMAKKSMKARDVKRANLAEKFFAKRAELKAIVSDVNVSDEDRWNAVLKLQTLPRDSSPSRQRNRCRQTGRPHGFLRKFGLSRIKVREAAMRGEIPGLRKASW

SEQ ID NO: 7240 - protein, 205 aa, Proteus mirabilis
VLDSKTAKKFVSSNLIKKLSSNLEYTMAKLHDYYKDEVVQKLMSQFGYHSVMQVPRVEKITLNMGVGEAIADKKLLDNAAADLAAISGQKPLITKARKSVAGFKIRQGYPIGCKVTLRGERMWEFFERLISIAVPRIRDFRGLSAKSFDGRGNYSMGVREQIIFPEIDYDKVDRVRGLDITITTTAKSDDEGRALLAAFNFPFRK

SEQ ID NO: 7241 - protein, 559 aa, Proteus mirabilis
IFNSCMGENMVALDKDLQSRQLARELVRNAKNAQQQYAKFSQEKIDNIVKHIAFEAARHAEELAKMASEETGFGKWQDKVLKNTFASLRVYEHMKDLKTIGIINDDKVKKVMDVGVPLGVITALVPSTNPTSTIIYKTLIALKAGNAIIFSPHPNAKQCSFRALEIVKKAALEAGAPEGIVDGVTLLTLEATKELMHSKDVSLILATGGEGMVRAAYASGTPTISGGPGNGPAFIERSADIKKAVSDIITSKTFDNGVICASEQSIIVERCIYNEVHRELLAQGAYFMNDEEAAKVASMLLRANGTINPAVVGKDAIYLSQRAGFTVPANTRVLIALQDTVSPKNPYSREKLCPILGMYIEEDWQSACHRVVQLLTNEGLGHTLVIHTQNEDVIRQFSLEKPVNRILINTPAALGGIGATTNITPALTLGCGAVGGGSSSDNVGPMNLLNIRKVGYGVRSVEELKQPCPLAQEAAQPAVSSANYHTSILDDDRFRSPSLTPVHAECATAQRQTQGDDRFGASPYTTTVSACAQQVIEQGEITEENVERIIKEVLGRLGK

SEQ ID NO: 7242 - protein, 631 aa, Proteus mirabilis
VMPSPCVNKGSTIMNPKNHDQFQNNFAALNETVQQVTERIVARSQITRRAYLKKIEAAKSQTVHRAQLACGNLAHGFAACQSEDKNLLKNMVHNDIAIITAYNDMLSAHKPYEDYPQKIKAALHTVGAVGQVAGGVPAMCDGVTQGQDGMELSLLSRDVIAMSAAVGLSHNMFDGALYLGICDKIVPGLTMAALSFGHLPAIFVPAGPMTSGLPNKEKVRIRQLYAEGKVDRNALLEAEAASYHSMGTCTFYGTANSNQMVMEAMGLHLPGSSFVHPDTPLREALTEAAAKQIVRLTENSGNYLPIGQLVDEKVIVNGIIVLLATGGSTNLTMHLVAMARAAGIMINWDDFSQLSQVVPLIARIYPNGPADINQFQAAGGLALIIRELLKKGLIHRDVNTVAGFGIERYTLEPWLNEGKLDWREGAIQSLDKDVIADINKPFSSHGGTQVMEGNLGRAVMKTSAVPDENKIIEAPAVVFNSQHDIAAKFSAGELNKDCVVVVRYQGPQANGMPELHKLMPPLGVLMDKGYKVALVTDGRLSGASGKVPAAIHVTPEAVNGGLLAKVQDGDIIRVNGKTGELTLLVDEQTLEARQTEIPDLSANNSGCGRELFVNLRRHLSGAEQGACCIDF

SEQ ID NO: 7243 - protein, 68 aa, Proteus mirabilis
PFSPLNSFEYELLKANSFGLFSNGFDTFIKVNDTIKNAITNINDTMIFLLIVHFFEFKSKDVIDKSSL

SEQ ID NO: 7244 - protein, 65 aa, Proteus mirabilis
EKLFNMCIYRNKNIRFFNLMCINNLSFCRLSWQKEAIKNDNSNDTVNFIFYVHKDIGQFAEIQLV

SEQ ID NO: 7245 - protein, 448 aa, Proteus mirabilis
KVSTNMETASSKTETTSYPATSAGARRAGMTEEQWRAAIKFDGNDVGWVIMSIGMAIGAGIVFLPVQVGLMGLWVFLLSSVIGYPAMYLFQRLFINTLAESPECKDYPSVITGYLGKNWGILLGALYFVMLVIWMFVYSTAITNDSASYLQTFGVTDGLLSENPFYGLILICALVAISSRGEQLLFKLSSFMVMTKLLVVAALGLSMIGMWHLYNVGALPPAGRLIKEAIITLPFTLTSILFIQTLSPMVISYRSRNQNREVARHKALRAMNIAFGVLFCTVFFYAVSFTLAMGHDEAVKAYEQNISALAIAAKFFPGGWVTVVSVMLNIFAVMTAFFGVYLGFREATQGIVMNILQRMMPVEKINEKWVQNGIMIFAVLLAWGAIILNAPVLSFTSICSPIFGMVGCLIPAYLVYKVPMLHKYKGASLYLIIFTGLLLCVSPFLAFS

SEQ ID NO: 7246 - protein, 113 aa, Proteus mirabilis
IRITIMFTGFLWLALSIGSEITGTSMIKKTNGFSKLAPSVLVIAAYCICYFALTRAMGYIPVGVAYSLWCGFGIVGVTLVAMILYKQKPDLPAIFSMALIISGGIIMNTFSTM

SEQ ID NO: 7247 - protein, 147 aa, Proteus mirabilis
TRITMKIDPFRAQQVYNSPSTLSSANNISRKGSDPIIENLKLTFYQDLSKADLSHANDILTLLDQFDVKDGGNQTLKEKRQIALLVYAHQQSELEHHENKNLINQALVSRLSYQGFYHQVTLELLGMIDNNDEFEGFFKPDRVTFSL

SEQ ID NO: 7248 - protein, 460 aa, Proteus mirabilis
RNTTMKDNTATPSSPFTIAKFGGTSVANFAAMEKCADIILKQKSVRVVVLSASAGITNLLIELATGVEATQRAALLAQVRDIEYAIINQLSQAEIISQEINRLLENIEMLSEAAALATSDALTDELVSHGELMSTLLFVELLREKGISADWFDVRKVMKTNDLFCHAEPDMAQLTELTQSLIQPRLTETVIVTQGFIGQEPKGKTTTLGRGGSDYTAALIGEALGMSRVDIWTDVPGIYSTDPRIVPQAHRIDHIAFDEAAEMATFGAKILHPATLLPAVRSGIPVFVGSSKAPEEGGTLVCAQTDNPPVFRAIALRRNQTLLTLHSLKMLHARGFLAEIFTILSRHHISVDVITTSEVSIALTLDTTGTTSSSGSLLTNALLTELSALCRVEVEEDLALVAIIGNSLSQVNGLGSQIFGTLEDYNIRMISHGASTHNLCLLVDGKDADNIVRKLHDTLF

SEQ ID NO: 7249 - protein, 1249 aa, Proteus mirabilis
DKKTTNLLYNENNNNTIFFGRGSNVTMITQQITQALAKRILVLDGAMGTMIQQYQLAEEDYRGERFAHWQCDVKGNNDLLVLTQPQIITEIHNAYFEAGADIVETNTFNATSIAMADYQMEGLCAELNEEAAKLARACADKWSALTPDKPRYVAGVLGPTNRTASISPDVNDPAFRNISFDTLVMAYREAICGLIKGGVDLIMVETIFDTLNAKAAIFAIKCEFDNLNIELPVMISGTITDASGRTLTGQTTEAFYHSLRHADALSFGLNCALGPKELRQYIQTLSQISETYVSAHPNAGLPNAFGGYDLDANEMAEQIKEWAQAGFLNIVGGCCGTTPAHIQAIAQAVDGIAPRTLPVIKKACRLSGLEPLVIDDNSLFVNVGERTNVTGSAKFKRLIKEGNYQEALDVARQQVENGAQIIDINMDEGMLDAIEAMTRFLNLIAGEPDIAKVPIMIDSSKWQVIEEGLKCIQGKGIVNSISMKEGEALFIEHAKLVRKYGAAVVVMAFDEIGQADTRERKIEICRRAYHLLTEKAGFPPEDIIFDPNIFAVATGIAEHNNYAVDFIEVCADIKSQLPYALISGGVSNVSFSFRGNDPVREAIHSVFLYYAVKNGMDMGIVNAGQLAIYDSLADELRNAVEDVILNRHAESTDNLLALAERYRGTKSEEQHSTLAQWRQWEVEKRLEYALVKGITEFIIEDTEACRQQASSPIEVIEGPLMNGMNTVGDLFGEGKMFLPQVVKSARVMKQAVAYLEPYIQATKKAGSSAGKVLLATVKGDVHDIGKNIVGVVLQCNNYEIIDLGVMVPCDKILQTAIDENVDIIGLSGLITPSLDEMVNVAKEMERRGFSLPLMIGGATTSKAHTAVKIEPNYSHPTVYVQNASRTVGVVAALLSATQKADFVAKTRREYEVVRQQYARKKPRTPPVSLATARANALQLDWQHYTPPKPNQLGVQQVTANIETLREYIDWTPFFMTWSLAGKYPRILEDEVVGEEARRVFADANAMLDKLSREKLLTPKGIVGLFPANRLGDDIIIYQDETRQHELLRCCHLRQQTEKKEYPNYCLADFIAPVDSGLADYFGAFAVTGGLEEDALANGYDNAHDDYNKIMVKALSDRLAEAFAEYLHQQVRTKIWGYSPDEALSNDELIREKYQGTRPAPGYPACPEHTEKAKIWQLLNVENRIGMKLTDAYAMWPGASVSGWYFSHPESKYFAVAQIQKDQVEDYAKRRGMSMSEVERWLAPNLGYEP

SEQ ID NO: 7250 - protein, 90 aa, Proteus mirabilis
LWKTVFTKRCSAGIWVISCPSRIICPSSASSKPAIKRNTVVLPQPEGPSMVKNSPWLIVRSRREMICFPSKPLLKDFNSTSGVRDVFSVI

SEQ ID NO: 7251 - protein, 85 aa, Proteus mirabilis
FMAASLVETDVSSISKVDQYFHKPVKTQSYELSEALEALKADTSNAAALAEYQAKLAEYNITRNAQSTSIKVIKDLAMSIIGNMR

SEQ ID NO: 7252 - protein, 429 aa, Proteus mirabilis
IMNARFLMFHNAAHPLRIQGNILEVMLRDVFIGEVCQLKENIFSENILGEAIVIGFHNNIAILSMMGSAQGYSLQIIVEPTGKTFSVALGPHILGSMIDSKGNCLLRFNTEIAEKTFNTLCPIEGRPPLFSDRLPITTLFKSGIRAIDGLLSCGLGQRMGIFASAGTGKTMLMNMIIRFAQADVFVIGLIGERGREVTEFIEELKQHKRCENTVLICSTSEQSAVERCNAALVATTVAEYFRQQGKNAVLFIDSMTRYCRALRDIALTAGELPVRKGYPASVFDKLPAILERPGVTKTGSITAFYTVLLESDDEPDAIGEEIRSILDGHIYLSRKIAASGHYPAIDVLGSVSRVFQQVTDSKQQKSALKIRQILMRLQDVKLLQELGEYHEGDNQLNDIAVRKQAKIESFLTQSFKEKVDFQQTFGTNV

SEQ ID NO: 7253 - protein, 336 aa, Proteus mirabilis
VIQAITPILFYYRLYREKLKSEGINMISSTSKGTLYGIVAIFLWSTIVGLIRNISEYFGAVGGAALIYTTGTLFLILILGVPKLSLFPKRYLAWGALLFVSYEICLSLALGFASDRAQAIELGMVNYLWPSFTLALAVFLNKQRFSILLIVGLLCSFSGLVWVVSGDNPLTIESLWNNICRNPLSYILAFIGAVLWAFYSNVTRLISGGHNGIVPFFFLTALALWGQYIFSAPIEWVVNVKSISLLLITGAAIGLANAAWTAGMISGNVTLLATLSYFTPVISTAFSSLLLSTALSFSFWQGVMMVTGGSLICWLATRQKMTKMPKTSKSNVKQGS

SEQ ID NO: 7254 - protein, 111 aa, Proteus mirabilis
IFKADEMIDSSKTINFRIGQRIRHLRKNLKYSGKLFAKELGISQQQLSRYERGTNRISIEFVYLITEKFDVHISYFLQSNYMINIEQQRNIQEKNSLLIAEACIKNGTNRP

SEQ ID NO: 7255 - protein, 66 aa, Proteus mirabilis
TIFLFYLQIINFHFKIYLNAPFQRAFLLNKKPFFVSFYKKTVHKIHFMKHHLISISTLSFYDASDK

SEQ ID NO: 7256 - protein, 231 aa, Proteus mirabilis
YYYYFLRKFMSIASSYDICHIVKNKVKNKLDLFLHTNKYLNQLRSEIVSLKNSNNTPDSLNINKQPLIGKGLSEIEKNIEFIDRILDQENKNLQQYKRDLNSFKTKHLPYPSSQKDITNMNKTLLSNISNKISNIKDIKDDLIKQRTELNNRRSLSKITTIDFLYYVEHKPFYIKKENISFSEIDIQCIHNMKKIYDNIWFKNVEDNLKSKLYSDIIKKIDKEKPLNKVVT

SEQ ID NO: 7257 - protein, 377 aa, Proteus mirabilis
KLHYGIGGKMNKKLTLTLCASLFLLSAGAMVYATMGSDEDETQPFAYPPTKVALATAQSAELPNTMHGVGELEAARQVYLAAETNGRIATIHFASGQTVTAGQILVKLNDEPEQAELLRLQAQLTNAEKLYSRTRQLYSKNVAAAAQLDSTLSERDMIVASIREVKARIAQKTIKAPFDGIVGIKLVHEGQYLNAGERVASLVDASHLKLNFSLDEQVAPQLSTHQPINIAVDAYPNQTFTGSLNAIDPLIGPSRTVQVQAILPNTDNKLKAGMFARVQVTSPTRHQALTVPETAVTYTAYGDTVFVAQSDNQKNLIAKRVSVKVGLRYNGLIEIKEGLNQGDQVVTSGQIKLSDGTSIAPIEQDTLTLAQSTTRQP

SEQ ID NO: 7258 - protein, 64 aa, Proteus mirabilis
AYLYALNGYTPAIYCASYFPPILAPPNYCLYTGDAGKNTSVNNKGLSESWKRERRNQCPFCCPI

SEQ ID NO: 7259 - protein, 287 aa, Proteus mirabilis
YGQYFWSVSMTVSPTNKKARKPKTPATQSTAQGGPVQSLSRGLTLLEYISESPGGIALTDLAFQAGLPNSTTHRLLTTLQQHGFVRQVGDLGLWVVGTHAFIVGSSFLQTRNLLVMVHPILRQLMEDSGETVNLAILDQVEFDAVIVDQVQCNALMRMSAPIGGKLPMHASGAGKAFLSTLPENKLLPLLQKKGLMAYTPYTKTLPSALKENLEQARKQGFSFDDEEHALGLRCIGACIYDEHHQPFAAISLSGPVSRMTDSRITELGALVIKAAKQISREYGGVKS

SEQ ID NO: 7260 - protein, 450 aa, Proteus mirabilis
IMSQNNNSHLWSQFIRQLREGVKPAVGCTEPISLALAAAKATALLAEPVVGIEAWVSPNLMKNGMGVTVPGTGMAGLPIAAALGATGGNPDAGLEVLLTASPQSIAQAKTLVAEGKVTVGVKTPCSDVLYSEAKVYGQSGYAIVSIAKEHTHVVRCECNGKVVFEDDKTSLTHAGDSVEEKPFATVCAEDIYRFALNVPIDQVAFMLDAAYLNGALSEEGLKNSYGLAIGRTLVSQQENGLLGKDLLSEIMIRTSAASDARMGGAVLPAMSNSGSGNQGIAATLPVMVVAEFIQADDETLLRALVLSHLMAIYVHSHFPPLSALCAATTASMGAAAGMAWLLTKDFTTVSMSINSMIGDISGIICDGASNSCAMKVSSSAASAYKAVLMAMQNQSVAGTDGIVSDDVDSSIANLCALASRAMQHTDIQIIEIMEEKARRNAGEKQQAVNA

SEQ ID NO: 7261 - protein, 82 aa, Proteus mirabilis
RLPHGKVFETNFRAWLLIAHGLRTSCLNATNFVCSVFLYKKEFDILLEKLILLDKTILFSSVTLIAAFYIINTLFIKKRINS

SEQ ID NO: 7262 - protein, 120 aa, Proteus mirabilis
NQGLRLKNHHADMMGNCKPLNGFLEEIKMGDALGLIETKGLVACIEAADAMCKAANVELIGYENVGSGLVTAMVKGDVGAVKAAVDSGVESAQRVGEVVTSLVIARPHNDINKIVIKHKA

SEQ ID NO: 7263 - protein, 211 aa, Proteus mirabilis
LYKQTGGGMKALTARQQQVYDLVRDHISQTGMPPTRAEIASQLGFRSPNAAEEHLKALARKGVIEIVSGASRGIRLLLEEEPEGLPLIGRVAAGEPLLAQEHIESHYQVDPMLFKPSADFLLRVNGMSMKDIGIMDGDLLAVHKTQDVHNGQVIVARIEDEVTVKRFKKVGSKIELHAENPEFSPIIVDLREQSFTVEGLAVGVIRNGEWL

SEQ ID NO: 7264 - protein, 608 aa, Proteus mirabilis
LKLQSIMVLVQHLIFLMKLRHYLVLHQLNFGELANIFMNIKNKIYCIIGIIIFYSFFLPTQAAEGKVIYTHQVKKPDVFVAVNTHIEQFFLVLSDKLNKPFILSSAVKKERISGKFDISSPEDAFELMVKRLSLLYFNDGESIYIYRDNEIQQQLFQVKNISLSKLKEYLQDVGLYDLRYPLRAGHDQRTFYLSGPPIYISLVKAAAELLDNDVQEQINENINNQVPTGSSRYGDEFVQIFPLKNTFVQDRTYILRDEKVVLPGITTVLQQLFMPSGEKEKTVRRAREIIEDNDKYQDDKITNDIQDTHSPIITQMGKYNVELVPLPGSNSLLVKTSREGLALVSSLISQLDKPKRQVELSLWIIDISKSKADSLGVNWQGSYGSGKNTFFFNTASLSAVSGFSFLSKIKALSEEGEAKMVSRPILLTQENTPAIFDNNTTFYTQIKGERVASLESTTFGTMISVLPRISNTNQEIEMIINLEDGAEKKSDDEDREEGIEKLPVINRTNISTVARVSEGGSLLIGGYTREDNIKAENKIPFLSAIPLVGRAFSYQSDNNKKMVRIFMLQPRLLDKTDTHGLDSLTEHPFLPMDKKTSQALKQIQAFMR

SEQ ID NO: 7265 - protein, 67 aa, Proteus mirabilis; identical to SEQ ID NO: 5213

SEQ ID NO: 7266 - protein, 141 aa, Proteus mirabilis
YMPNSIARILESQTLWIVARVLILLLFLSSGFAKVFDYENSLAEMRAAGLNPDWFFNLASAIVLFAGSILVLFDRYLWLGAGALATFLFLTIVIVHTFWNMTGDKAMLSMYFAIEHTSVIGGLMATAMASHFRALWKKFNS

SEQ ID NO: 7267 - protein, 67 aa, Proteus mirabilis
EKAKSSLYTKSAISRLALYVLSRTHYAASLAGINSQCFRRWGTEGIFARIRRNARPIFIERESNVDF

SEQ ID NO: 7268 - protein, 150 aa, Proteus mirabilis
QMSKEKIDFNRALTVGEVAKRSGVAISTLHFYEEKGLIKSSRSPGNQRRYPSVVLRYVAIIKAAQSTGIPLKEIQEILGKYPPNSKLTAEQWHEISTDWKIRLDERIRRLKRLRNGLDHCIGCGCLSLNDCPLRNPDDILGEKGPGAQML

SEQ ID NO: 7269 - protein, 88 aa, Proteus mirabilis
TMILAKVIGHVVATQKSPELKGSNLLMIATLDDELNPLKNKTYVAVDSVGAGINDVVLAEEYFALNKDRYKAMSVVAIVEKVYRDSKE

SEQ ID NO: 7270 - protein, 446 aa, Proteus mirabilis
PMLKNLRYKTKVKIKNRKGALVMNIERKILVKLKNIHSLDQNKKLLRSGYHNQYNTFLSNISFVPVLSSSQLPPKNHLSLTSNHLNDYYYLNLPNDNTYTLDEIIKILKQHPDIEYVQKIPKLPVQPPNITPDLTRHQHYLKTPKIKSNEINGLGIIDAWNKNAYGQGIQVADIEWDFDLSHPDLLANNITPLFPLTEKTDQADHGTAVAGLIMGKKDGKGITGLAYKLDMFYAISELSSGRIEAIIASKQKLHAGDIVLYEMQTVCEHHAYVPADYEMHIWEATRTLTEAGIIVIMAAGNGGVDLDLPFYDSYRQRSDNHSIRVGAGSPYTLNRLPFSTHGSPIHVQAWGEDVTTAGYGDLFHGDGNNKYTANFSGTSSACALVAGAAAVIQSWYKDKTNTVLTPIEMRELLIKTGTYPSLNEKIGPLPNVNNAILHLKNLIQYN

SEQ ID NO: 7271 - protein, 207 aa, Proteus mirabilis
KCGKFLYPVGFSHDWQSDARHFTQEENTLVFAFIAALIIIYLVLAAQYESLVDPLIILITVPLSICGALVPLALGMVTLNIYTQIGLVTLIGLISKHGILMVEFANELQVHKNLNRREAIIEAAKIRLRPVLMTTAAMVIGLIPLLFASGAGANSRYGLGLIIVSGMLVGTLFTLFVLPTMYSFLARNHQVSAQTERQKQLQQISEQ

SEQ ID NO: 7272 - protein, 292 aa, Proteus mirabilis
GELKLEGSMTHNKWQAYSRLMRIDKPIGALLLLWPTYWALWIAAKGFPDWHILIVFTLGVFSMRAAGCVINDFADRKIDGNVERTKNRPLPSGAVTEKESKIIFIVLVLFSFGLVLTLNTMTIWLSIAALALAWFYPFVKRFSNLPQLILGMAFGWSIPMGFAAVSETLPLVCWLLFLVNIIWSVVYDTQYAMVDRNDDLKIGVKSTAILFGRYDKIIIGILQLVMLALLVAIGVLLNMKGIYYWSLLLVTALFIYQQKLIAERERAPCFQAFMNNNYVGFVLFAGILFNYF

SEQ ID NO: 7273 - protein, 60 aa, Proteus mirabilis
LPIKNFLGDVTERGNIEDITKFLYLDFATVSSRINIYLTPHQNSNLVNSVIDIINIFYLV

SEQ ID NO: 7274 - protein, 704 aa, Proteus mirabilis
LLAKFMIYKFLLAIKNKPELIVLSVMILVIMMLIIPLPTYLVDFLIGLNITIAILIFMSSFYIKRILNFMTFPALLLITTLFRLALSISTSRLILLDADAGEIITSFGEFVIGENLVVGFVVFSIVTIVQFLVITKGSERVAEVAARFSLDGMPGKQMSIDADLKSGIITNEEVQIRRKELGQESQLYGSFDGAMKFIKGDAIAGIVIIFVNLIGGISVGMAQMGLSITEALHTYTLLTIGDGLVAQIPALLISISAGFIVTRVGGENNNLGYSIMNELLAQDFALLVTAILAFGIGFLPGFPTPVFLILSVMLGVYFFKIKWKSSKKEYKTEDEKDNHNATNADSKKGLMSNLFSGKHGEEVDNSLLTENITLSQAETLPLIITLSTKKKPYLTKIVFEKWLQKEFILQYGILLPDIVIHYSDKIDDDKIIILINEVKAKELNCPFPLFHIENPNDELLSLGFNLISIEDDNKTHYWIERDDESKLAPLGYKAERSESYFYRKFSDLITLNITEFLGIQETKDILDKLEKSAPELLKECYRQVSIQRINDVLQRLVQEKIPIRNIKTIIGGLVQWGSKEKDPVLLTEHIRTLLARYISYFFSTDGKFNAIILSNDMEEIIRSGIRQSSSGTLLNLEPAELDMIIEKISMVIDDIKYIQDYIFLTSIDIRRFVKKLIETQYPQIPVLSYDEITSDIEINVLQSI

SEQ ID NO: 7275 - protein, 112 aa, Proteus mirabilis
HQQNCYQTQGIVFALGERMGDALGLIETQGLVACIEAADAMCKAANVELIGYENVGSGLVTAMVKGDVGAVKAAVDSGLEAAQRVGTVVTSLVIARPHNDIQKIVAQYKVTE

SEQ ID NO: 7276 - protein, 264 aa, Proteus mirabilis
EGRNRMIGRLLRGGFMSIIYAYLYIPIIILIVNSFNSSRFGINWKGFTTDWYTILLNNDSLLQAAGHSLTMAVTSATFATLIGSLAAVALYRYRFRGKKFVGGMLFVVMMSPDIVMAISLLVLFMLLGISLGFWSLLVSHITFCLPFVVVTVYSRLSGFDVKMLEAAKDLGAGEFTILRKIIMPLAMPAVASGWLLSFTLSMDDVVVSSFVTGPSYEILPLKIYSMVKVGVSPEVNALATILLGLSLVLVLISQLILRDRTGKA

SEQ ID NO: 7277 - protein, 851 aa, Proteus mirabilis
QECFMKFTDIFVRRPVLALVVSTLIFLLGAFAFSKLPIRQYPMLQNSTITIATDYPGASSELMQGFVTQPITQAVSSVEGVDYISSSSVQGKSFVTVRMELNRDPTQALTQVMAKVNQVRYKLPEQAYDPVIELSSGESTAVAYVGFSSEQISIPELTDYLSRVVEPMFSSINGVAKVQVFGGQQLAMRVWLDTDKLAGRNLTASDVADAIRRNNYQAAPGKVEGEFVIANVYVNTDLTNVEEFKDMVIHNDGHNLIRLRDIGTVELGAAATETSGIMNGKKAVFLGLFPTPTGNPLIIVDGIRENLTDIEKTLPPGVNVELAFETSRFIKASIDQVVQTLIEAILIVIAVIYLCLGSLRSVIIPVLAIPLSMLGAAGLMLAFGFSINLLTLLAMVLAIGLVVDDAIVVVENVHRHIEEGLSPVQAALVGAREVAGPVIAMTITLAAVYAPIGLMSGLTGALFKEFAITLAGSVIVSGIVALTLSPVMSSLMLKPKENEGRMAKIAEYTFDKLAYYYSYLLNFSLTHRWLTVVFALAVFVSLPFLYSQTKQELAPLEDQASVLTAVKAPQHANLAYAEHFNQKLDDIYMSLPETDSTWIINGTDGPSASFGGINFDGWKGRDRNANQIQADLQNRVADVEGSSIFAFQLASLPGSVGGLPVQMVLRSPLGYPVLFDTMEEIKQQARESGLFVVVDSDLDYNNPVVQITIDRAKANTLGIRMQDIGESLSLLVGEHYINRFGMDGRSYDVIPQSIRQQRLTPAALAGHYIRTQDNLLIPLSTVVNITTQVEPNKLTQFNQQNAAIFQAIPAPGVTMGQAVAFLENVANSFTRWALAMIGNLMLAILPKKKIP

SEQ ID NO: 7278 - protein, 371 aa, Proteus mirabilis
MTEKTSLTPLVELKSLSKGFDGKQIISRLDLTINHGEFLTILGPSGCGKTTVLRLIAGLEDADDGQIILDGQDITHIPAEQRFVNTVFQSYALFPHMTVFENVAFGLRMQKTPAAEINSRVMEALRMVQLEDFAQRRPAHLSGGQQQRVAIARAVVNKPKVLLLDESLSALDYKLRKQMQNELKALQRKLGITFIFVTHDQEEALTMSDRIVVMKEGRIEQDGTPREIYEEPTNLFVAQFIGEINIFDARVLHRIDETRIRADVEGHECDIYTQLPVTQNQQLKVLLRPEDLRVEEIHDLENLPGLIGYVRERNYKGMTLDSVVEMENGKMVMVSEFFNEDDPDVDHSLDQKIAVTWVESWEVVLADEENT

SEQ ID NO: 7279 - protein, 60 aa, Proteus mirabilis
PREKIQCIGAKLNFGFYQKLTHVVITPYCPDKPSQQWQPRTSPCNDLYLVRSILQPTPHR

SEQ ID NO: 7280 - protein, 183 aa, Proteus mirabilis
TFCENDTGVPIMHKLMLIVALSLLFTTKGSAYDTLVHINARVTGNTCTVETNSKRITVKLGQIATKDFISTTITQQRTPVIPFSIKLVDCQPEASAVKVSFNGRADPIDNALLAIDATGAKGVAISIMDNSGASIDINDKSQSYTLLPNQDNTLQFYARYVATQLPVQAGSANATATFLLEYQ

SEQ ID NO: 7281 - protein, 98 aa, Proteus mirabilis
ITKEINMKEALGLVETKGLVACIEAADAMCKAANVELIGYENVGSGLVTAMVKGDVGAVNAAVESGVEAAKRIGTVVTSRVIARPHNDIEKIAEQHKA

SEQ ID NO: 7282 - protein, 181 aa, Proteus mirabilis
LLLLFLEILMKISGKLLCFLSALIFILVATYAATRLLTIKNEGMMVCSTKGIMRFENMEDENVNGNIHFSFGANGKGSIVVEGYTTSKAGWLYLQRYVKFDYTTKRVSPTERHYFVSQWESSASSIDESPDVIFDYFMREMSDSHDGLFINAQKLNEKTLLLSSLNSPLYICTLKPGSKFD

SEQ ID NO: 7283 - protein, 385 aa, Proteus mirabilis
SLILIFLAVSYLTTCYVILLLYFYLYVHQGSRHLNRRKNYSMSENTERNKTTENHPINDNKRTDNLNRFSVAPMLDWTDRHCRYFFRQLTKNTLLYTEMVTTGAIIHGKGDYLKYSNEEHPISLQLGGSDPQALAQCAKLAQERGYDEINLNVGCPSDRVQNGRFGACLMGEAQLVADCVKAMRDVVDIPVTVKTRIGIDNQDSYQFLCDFIDTVSRDNNCDTFIIHARKAWLSGLSPKENREVPPLDYPRVYQLKRDFSHLTMAINGGIKSLEEAQEHLKYMDGVMVGREAYQNPSILAHVDHVLFDNQLPVANAVAAVKAMYPYIEKELSQGTYLGHITRHMLGIFQGIPGARQWRRHLSENAHKQGADLTVLENALKFVTEK

SEQ ID NO: 7284 - protein, 60 aa, Proteus mirabilis
GMSWVYIFHSQYSLKITIRYSQIVACHLIVTVNSFLFDNIRQNHSTNLVLITYIGKTDNL

SEQ ID NO: 7285 - protein, 347 aa, Proteus mirabilis
MKKWSSVLAASVMALSIGTASADDGKTIYFYNWTEYVPPGLLEQFTKETGIKVIYSTYESNESMYTKLKTYKDGAYDLVVPSTYFISKMSHEGMLQKIDKSKLSNFDNLDPSLLHKSFDPQNDYSIPYIWGATAIGINSDEVDVSSITSWADLWKPEYKDSLLLTDDAREVFQMALLKLGYSGNTTDPKQIEEAYKELQKLMPNVLAFNSDNPANPYMQGEVNLGMIWNGSAFIAREAGAPIELVWPKEGGIFWMDSLAIPANAKNVEGAHKLIDFLLRPEVAAKVAENIGYPTPNLAAQKLLPKAITKDSSLYPSEEIISKGEWQNDVGEATVLYESYYQKLKAGR

SEQ ID NO: 7286 - protein, 72 aa, Proteus mirabilis
RILLGGHSAVVPPDPMPNSEVKRRSADGSVGSPHVRVGNCQALNKTRKPTLWVGFFAFRRSYFTLSHANTFL

SEQ ID NO: 7287 - protein, 855 aa, Proteus mirabilis
SQHRFQPCWSKTMVNKNTNKDIVYFLFPSVIALSLTLSFSSYSANRFNPAFLADSPDAVTDLSYFEAGNRIKPGDYLLDIVFNHEYLRSENIHFISQDNHVIPCLNRDDYQSLGINIKLFADFEKFSANECIDIEKIIPDSVVNYDIEKQALNIQVPQAALDLKARGYIPPEKWDNGITAGILNYTFSGANSWGNSHNNSYYLNLRSGINIGAWRLRDYSTWNSSNGKNQWNHINTYLQRNIVSLRSQLQIGDSYTSSTLFDSVNFRGISLESDDTMLPDSQRGFAPVVRGIAKGNAKVVIRQNGYVIYQTFVSPGAFEIRDLYPTSNSGDLYVTIEENDGSKHSYVVPYSAVPILQREGQKQFVIQAGEIRQNNQHKKPRFIQGHLIYGLPYDTTVYGGALATKDYQSYALGAGKNMGTLGAFSTDITFAHSQLPNNSTSDGYSLRFLYAKSLNQFGTNFQLLGYRYSTSGFYTLDETLNTRMSGYLYEDNQKKPLSYFNLHNRKKGSLQINLSQQLGDYGSIFMMTNWQNYWGTNEKNVLVQTGYNGNIKGLSYNVIYSYNRMMNSGQRDQTLSVGLSIPLQLLMPTSYQSINSTYLTYNYSHNNNGYSTHNAGIAGTLLEDNTLNYSVQQGYSNQGGNYTGSAALGYQSRYGNLNASYNYHQDAQQINYSLAGGMLLHSGGLTLSQPLSANAILVDARNTADVPIDNATGVYTDWRGFAVIPYATAYRQNRVALDTTALPDNVEIEQNIKQVIPTQGAVIKVQFDAKKGYRLLLTLQHQGRPLPFGAIATDKQNHLSGIVGDDGLLYLSGVPDSGKLEIRWGHNASQYCQVNYQLPASQLDEPFVKMTQECQ

SEQ ID NO: 7288 - protein, 994 aa, Proteus mirabilis
EQDRHFIVLIWQIFIIIQFQYIYCISIQLVLCHNYPILSFSATHLIRDIFMDKIEVRGARTHNLKNINLVIPRDKLIVITGLSGSGKSSLAFDTLYAEGQRRYVESLSAYARQFLSLMEKPDVDHIEGLSPAISIEQKSTSHNPRSTVGTITEIHDYLRLLFARVGEPRCPDHDIPLAAQTVSQMVDNVLAQPEGKRLMLLAPIVKERKGEHVKLLNNLAAQGYIRARIDGEVCDLSDPPTLELQKKHTIEVVIDRFKVRDDLAQRLAESFETALELSGGTAVISDMDDSSAEDIVFSANFACPICGYSMSELEPRLFSFNNPAGACPTCDGLGVQQFFDPDLVIQNREISLAGGAIKGWDRRNFYYFQMLRSLGEHYHFDVEAPFDSLPDKIQKVILSGSGKENIEFKYTNDRGDVVVRHHPFEGVLNNMERRYRETESSAVREELAKYISNRPCASCGGTRLRREARHVYIENTTLPEIADYSIGHAMSFFQNLKLSGQRAKIAEKVLKEIGDRLKFLVNVGLNYLTLSRSAETLSGGEAQRIRLASQIGAGLVGVMYVLDEPSIGLHQRDNDRLLETLIHLRDLGNTVIVVEHDEDAIRAADHIIDIGPGAGVHGGEIVAQGTLEDIVNNSNSLTGKFLSGERRIAIPEKRVPVDREKMLTILGAKGNNLKNVNLKIPVGLFTCITGVSGSGKSTLINDTLFPIAQRQLNGATNSVPAPYLDVEGLEHFDKVIDINQSPIGRTPRSNPATYTGVFTPIRELFAGVPESRTRGYTPGRFSFNVKGGRCEACQGDGVLKVEMHFLPDVYVPCDQCKGQRYNRETLEIKYKGKNIHEALDMTIEEAREFFDAVPALARKLQTLIDVGLSYIRLGQSATTLSGGEAQRVKLAKELSKRGTGQTLYILDEPTTGLHFADIELLLDVLHQLRDQGNTIVVIEHNLDVIKTADWIVDLGPEGGSGGGQILISGTPEQVADFEGSHTARFLKPILERGY

SEQ ID NO: 7289 - protein, 208 aa, Proteus mirabilis
GTYRLVGIILRMNTTAHHRKKDPIRVQEQLLEAASIIVANEGIASLSLNAVAKEAGVSKGGLLHHFPGKIELIQAVFKRLLGIMDKRIALIMANDPIEAGRFSRAYLTYISDLKQSDESRQLAILSLAMPNEPIMRQCWRDWMLGHLAKGDKLDNSYLGTLIRYAADGLWLSELTEGPTISQQERSALVERLLKMTFEYMADTANQSC

SEQ ID NO: 7290 - protein, 304 aa, Proteus mirabilis
IYGRHSKSVMLIRMNEGTMKYRINASIYYDATDGAISLEKGDVDTHLSITANALLFYFIQNPGVVNRDEVLKRVWDDNGLVSSNSNLNQYLSLLRKTFRHYGIENIIVTIAKGRLEFNPDISVELIDDSTLLPVTQTNEHEGEANKSHTASPIETSLSSEPDNLDSELEKEPQLSVTSPQKPEICWYLASIGFLFGAIFLVVIIFLNQHQSKPITLTPLTHNDCELLSNEAMINSSVSDNYIRNFDAVRKKLNLQCVKGERFVFFYGDKLQTNGLGRVFLAHCAKNEDNPFSYCDNYFYYSWKY

SEQ ID NO: 7291 - protein, 174 aa, Proteus mirabilis
YSLRQADINSCSLLLAILRKHNRKSFVDLWCCDNINREKWQNNRLFSIEFIMANQNKGLTRIIKAGGYSYQGLRAAWINEAAFRQEAIVTLIAIILAFFIDVSVLERILLIGSVVLVVILELVNSAIEAVVDRIGTERHELSGRAKDMGSAAVLVAIILGLFTWGTILWHHFFA

SEQ ID NO: 7292 - protein, 231 aa, Proteus mirabilis
IMLRLLPDNLLKYTCEGVLIRAHYIRQLDNIHKTTLATKQAAKKMLHHFNHKLDKLRNKIANEAYAKGLQVLLADIIRFSIEYQEKFVQYEFQQREQLVATIGEFLDSPEIQVKLTQYLMSSVPLEQKVTLDIPTTLQRYFESELDNSNIKLNCHNNKTIAIHTGDQITFFDPAIFLNDLRTQFHRPFSETYQPIFEQNIKQLLLNFINTFTPSDDLSSRKPILNEDNNEN

SEQ ID NO: 7293 - protein, 439 aa, Proteus mirabilis
LLFRCYLYDKNKGIAMKLETLSVHAGYSPDPTTKAVAVPIYQTTSYAFDDTQHGADLFDLKVPGNIYTRIMNPTNDVLEQRVAALEGGIAAVAVASGMAAITYAIQTIAQVGDNIVSVAKLYGGTYNLMAHTFPRIGIEARFAPHDDLLALEALIDEKTKAVFCESITNPSGNIVDIQALATVAHRHGVPLIVDNTVATPYLCRPFEHGADIIIHSLTKYIGGHGNSIGGIVVDSGKFPWAEHKDRFEILNTPDVSYHGVNYVEHFGAAAYIARCRVAPLRGTGAALSPFNAFLILQGLETLALRMERHTENAQKVAEYLQNHPQVVWVKYAGLTSHPEHNLAVRYMSGKPAGILSFGIKGGAEAGAKFIDALKLIVRLVNIGDAKSLACHPASTTHRQLNDEELERAGVSRDLIRLSIGIEHIDDIIADLEQALNASF

SEQ ID NO: 7294 - protein, 178 aa, Proteus mirabilis
DHHSCDDERMFKKSIITHAPIHWLSDEEREEVAENTLSWLLELGSMTRRFEQHCHQVTVMPYQEGFIEYIEPADEQKCLPYSRRYWLREIVLCGDNVPWLLGRTLVPEETLTGEDRQLVNLRTVPLGRYLFQETTLSRDFIHIGQQNGHWLRRSRFQLSDKPLLLTEVFLPASPVYKQ

SEQ ID NO: 7295 - protein, 419 aa, Proteus mirabilis
TNNSTQDIVSIWHTKSDWRIKAVFQQVEAFAGDPILSLMDVYNKDPRQDKINLSIGLYYDEEGKTPILGTVSVARQQLNAMTPTATLYLPMEGLAPYRHEVQTLLFGADNPLIADKKIATIQTLGGSGALKVGADFLHRYFPSSEVWISDPTWDNHASIFAGSGFKVNYYPYFDPETKGVKFDALIDCFKKLPEKSIVLMHPCCHNPTGSDLTKAQWDQVIEILKARQAIPFLDIAYQGFAESLDDDAYAVRAMAKAGLPVLVSNSFSKIFGIYGERAGGLSIVCDNAKECEHVLGQLKAGARRIYSSPANYGAQLVNQVLSDHVLTAQWQKEVAHMRDRIKEMRVTLVNALKEALPEKNFDHLLTQRGMFSYTGFSPEQVDRLREEFGIYLIGTGRVCMAGVNNNNVQRIAQAFAAVS

SEQ ID NO: 7296 - protein, 201 aa, Proteus mirabilis
ACIRKKDMMMSYTLYLQQTPTVGTKVPFPSLAKGNYPLNEVIINAFLNLMQLTGNLDTDALLDEKMFDKIWLKAEMTPARMEEIGDYIYHHIPTHPAPLEEEITLFKQAMQEEEALLAKESEKEGCIPIYKFATNDGWIVTPKECEIIASALTAKLLEDNHVFVEQVAKMSHIAYRSLEIALIDFGKFNQFAKKYGGYRVY

SEQ ID NO: 7297 - protein, 379 aa, Proteus mirabilis
YMLRIMPNVSAKINSIRNFLGIKDPTGNLNVSSVKNSSAIWYKKDLSEKKTPVLYMRQNINNVNNIQRLVSTEVLNKLYYDENSPQYDENNYQCVPNSRYRVRYCKKTLIESNGVLLPTNNVSVKNSPYTTIASQYPLNDKESLKHYFNMLFDNDIKTVYVLASDKDIKWDFSKPDSEYDKINSKQKGFKYFREGFYSDNIKSCHFKKWDFSYFEIKDNNGGYKIVDNKNGDNEILLNERQLDCKVYIKRLTKKGCDKKKDIKFVHIYNWEDHTAIDAIKLKNTIDFIGKKFTINPTKENIAVHCLAGLGRTGEFIALMEMMKMIEAGNTKTKSLESILVHLRENRSREVLKRKSQVDELIKFAINHNIPLVNDNIEIK

SEQ ID NO: 7298 - protein, 297 aa, Proteus mirabilis
LGLRAGRSCWLMKKTRKLFQNIVITGVVGWLMVFVFLPNIMIIATSFLTRDDANLVEMVFTLDNYYRLFDPMYAEVLLHSINMALVATLACLILGYPFAFFLAKMPKKIQPLLLFLLIVPFWTNSLIRIYGLKIFLSTKGYFNEFLLWIGLIDKPLRIIYTPEAVVLGLVYILLPFMVLPLYSSIEKLDKPCLEAARDLGANKLQTFIRIIIPLTMPGIIAGCLLVMLPAMGLFFVADLMGGAKNLLIGNVIKSQFLNIRDWPFGAATSICLTLVMGLMLFVYYRAVKLLHKKVEIE

SEQ ID NO: 7299 - protein, 184 aa, Proteus mirabilis
SRLRASYPMNEEKLLAQAEKICQKRGVRLTSQRLAVLRLIMQQPTAISAYDLLDLLRQVEPQAKPPTVYRGLEFLLEQGFIHKIESTNSYVLCHHFDDAEHTSVMLICDRCLSVTEKSSHKIEGAISTLAKDNGFHLRHSVIEIHGLCAQCHEAQACTHPEGCHHDHSMDDNLKQKKTGDYKPR

SEQ ID NO: 7300 - protein, 192 aa, Proteus mirabilis
ARMSNLTAEQFKLISNVMYEPLSYIHSDYDVLASPKENTLWQKIANRHLIGQYQLILHIDCEIDTTVEKIFTHWHTLPRCALFLGYFYSRHTLLAQNYYHLEPALKAFLALYPMLNRTVDSKILLSLKDIAPIDIGYQLLFNFIKLISNALAQRFKLLFSPKSLSINIEFPKSLVLSPTLFLLVLNYATLVT

SEQ ID NO: 7301 - protein, 98 aa, Proteus mirabilis
VLRRLCMAIAPIIPVNLTKELQDTSDDSLSTIMVNGIISSMQYEKKIQEKLTTLSQLGDAQSYTNLQIELSDYSITMSLASTLARKSLNIVETLLKAQ

SEQ ID NO: 7302 - protein, 144 aa, Proteus mirabilis
KFRSLIMSPKAKSWLWMLAVIISETSATSTLKMFDNSEGITKTLLLGLIIVLYIVCYYSLSRAVKNIPVGLAYATWSGTGILVVSTLGMAFYGQHPDTAAIIGMAVIASGIVIMNLFSKMGSEEEPEETTDLSNIKQTVSSVNK

SEQ ID NO: 7303 - protein, 60 aa, Proteus mirabilis
IIFGKCQIRLFYLLKQKRVIAIFVKTNKLPYIHLSQIYKNYKCGKKNREIVLNDRFLLVL

SEQ ID NO: 7304 - protein, 323 aa, Proteus mirabilis
CRFGGVKMETAAEIRGRIFNIQKYSIYDGDGIRTLVFFKGCNIRCPWCSNPEGLSSEFQVMYSRDKCVDCGKCVDVCPAGVHYMTTNEQGQQVHRVDRAVDCIGCRQCEEVCLSDALDIMGKDVSVSELMDIIMQDYDFYISSGGGVTIGGGEMSLQTDFAVALLRECKKMMINTAVETQATTNVANYEKLAQVVDQFLIDIKHIDTTQHKALFGIGNENVRRNLERLMDLGANVVIRMPLVRGYNDSYDAITGAINYAMALSKRGNLQRIDILPYHQFGRNKYQKLEMIYPIKNDPGYTPEELDRLEAFFKQFDFEIRLVRH

SEQ ID NO: 7305 - protein, 537 aa, Proteus mirabilis
KILGECRMSQSLTTEALSFTKPFGIAEKEILNHDVESFLTDLVSQFSERRDTLLAEREIWKQKVDNGMLPDFISESDSIINSEWKVNPIPKDLQDRRVEITGPVDRKMVINALNANVKVFMADFEDSLAPTWDKVIDGQINLRDAVKGTISYTNEQGKCYQLKASPAVLIARVRGLHLPEKHVLWQGKPIPGCLFDFALYFYHNYKTLQAKGSGPYFYIPKLQTWQEAKWWSDVFHFTEKRFGLASGTIKATVLIETLPAVFQMEEILFHMKEHIVGLNCGRWDYIFSYIKTLKNYPDRVLPDRQGITMTQPFLSAYSRLLIQTCHKRGAFAMGGMSAFIPSRSAEQNGVILQKVFEDKELEATNGHDGTWIAHPGLAETVLSAFDAVLGERANQLDVQRHEKITADMLLAPCEGERTATGMRANIRVAVQYIEAWISGNGCVPIYGLMEDAATAEISRTSIWQWIRHQKPLSDGQIVTKALFRNMLKEELEVIRQEVGDTRFEQGRFKEAATLMDNITTQDELVDFLTLPGYQLLN

SEQ ID NO: 7306 - protein, 1149 aa, Proteus mirabilis
RTSGEPHMAKYSLTPRVKMLAERLVSRNSSISTERATIFDSLDNNIAGVPQAIKPAQRFYQFIRHFPSYIAQDELIIGSQSSTPRGAIFHSEEEVRSDSIYRFLSINNSVASPDYMLVVNQGFLAIKAQLEDRMRSIGSAVNRSSMDEANFCKSAIYACDAALYFAQLLSAKAENLAAMEGNPYRKAELLESAAILRKVPAKPAETFKEAVQVFYLLQLILHLENGSYAINPMGFDKALYPFYQRDIDQGRLTPAQAYEIVESLWLKLAELSEVRATKEVDGYPMFDAMTQGIDINDPRVSINELSEMLLSARANLSALHSSLQVRLYNGRMNTPPQYASPSANVVTPATANGELTVMEGLTPRLQRLRNRYLEARPSVSIYRALAFTEIARNNPGLPPILLRAKAFRRACETAPILIQDEELIVGHPCGKPRAGAFSPDIAWRWVRDELDTMSTRPQDPFQISEEDKKVIREEIVPFWEGRSLDEICEAQYREAGVWEFSGETFVSDLSYHQINGGGDTCPGYDVLLFTKGMNGIKADAQAKLAELSMENPADIDRIYFYKASIESCEGVIAYAHRIAEHARELASKESEPQRREELLTIAQVNENVPANPPKTLQEALQSIWTVESLFEVEENQTGLSLGRLDQYCFPMYENDIKTGRLTREQALEMMQAFIIKCAELMWMSSELGAKYFAGYQPFINLTVGGQKRSGGDACNDLTYLIMDAVRFVKVYQPSLACRIHNQSPQQYMEKIVDVVKAGMGFPACHFDDSHIKMMLRKGFDFEDARDYCLMGCVEPQKSGRIYQWTSTGYTQWPIAIEFVLNRGRMVLFDSYQGLDTGDLRDLRTYEDFDRAVKEQVAHIIRLSAIGTVISQRVHRDIAPKPLMSLLVEGCMEQGKDVTAGGAMVNHGPGLIFSGLATYVDSMAAIRKLVYEDKKYTLEQIRDGLLANFEGHEELLRDCLNAPKFGNDDDVVDQYALDITEWTERECRKYKMLYSTFSHGTLSISNNTPIGELTAATPNGRLAWKPLSDGISPTQGADKHGPTAIIKSISKMNVETMNIGMVHNFKFLKGLLDTNEGRQGLITLLRTASILGNGQMQFSYVDNEVLKKAQLEPEKYRDLIVRVAGYSAYFVELCKEVQDEIISRTVIEKF

SEQ ID NO: 7307 - protein, 81 aa, Proteus mirabilis
RWTGTLGLPACGFFTRIIVTYVSIRTSDTSNIPHSTPSQAYRTLPYPTTLRVAAAASVHGLAPLHLPRGPTRPVSYYAFFK

SEQ ID NO: 7308 - protein, 188 aa, Proteus mirabilis
LSFIFTKVIFVKDAVILVDKNDNELGTMPKLEAHITGALHRAFSLFIFNSKQQMLIQQRALTKYHSGGLWANSCCSHPLPNEPLSQAIHRRLNEELGMQCDMQPIGTILYNEKVTDDLIEHEFDHLFLGFSDKTPLCHPDEVMDHRWVSLNELYHDVEKHPENYSAWFCHILMALGIEQFTRWSKNIT

SEQ ID NO: 7309 - protein, 228 aa, Proteus mirabilis
IFIMKKIFAFIIFLFPLIAYSNGVSLGATRIIYNSNIKQTNLVVTNSDKENSFLIQSWVSDNQGNKNNDFIVTPPLYILDANKENALRIMYTGEPLPADRESLFWMNVKAIPSLDEKLANENTLQIAIQSRIKLFYRPSGLSAYTEKYANEVTFSYKNGELIAHNPTPYHITMVNLATVDSQLPSSIMINPFSQLTLGKVNQNAHTISFQTINDYGAQTPVLKKEIVH

SEQ ID NO: 7310 - protein, 361 aa, Proteus mirabilis
GDIMIGPINTATSTNGASNSISKESQQDIEYKQPQINESENYQNQLIEISDDMSMVATLFSQRLGKLLDKKANKGQEALYIAEDGADEKLDKVMLQFRKSGRSLQELLQYLRKMFPDPSDLVMVLRELLRKKKLGAQLDAGIENEINRLLAGEEGKQIKAGINIALQAKAFAKLLCLDASVLRDLYRSYIILDIEPIYFFKMWIEKYDIKKCSIILNFLTQSLICDMKSLMPSCSQSSEFGYLLEKVNKLRLLYSFIEMNIENLVKEDLKSFIKEDDFYQLTINGMISPEQMEKYLISLMDNQWKGYFIKIKMRLLQQLKTMFNKYPELLYLSDDFRNECQIMIQKIIDNYIKQEQYQLRK

SEQ ID NO: 7311 - protein, 451 aa, Proteus mirabilis
TANIKHHHYQIYRSYFMSMSRSEQIAQLEKEWEQPRWKGIKRPYSAEDVIKLRGSVNPEHTLARRGAQRLWSSLNGKSKKGYVNALGALTGGQALQQAKAGLEAIYLSGWQVAADANTAASMYPDQSLYPVDSVPNVVQRINNTFRRADQIQWSNGIGPQHKDYIDFFLPIVADAEAGFGGVLNAFELMKAMIEAGAAGVHFEDQLAAVKKCGHMGGKVLVPTQEAVQKLVAARLAADVSDVPTLLVARTDADAADLLTSDCDPYDSSFLTGERTTEGFFCTHAGIDQAISRGLAYAPYADLVWCETSTPDLKMAAKFAEAIHDKYPGKMLAYNCSPSFNWKKNLDDSTIAHFQDELSAMGYKFQFITLAGIHSMWFNMFDLAHDYAKGEGMKHYVEKVQEKEFAALSKGYTFSSHQQEVGTGYFDKVTTIIQGGMSSVTALTGSTEEQQF

SEQ ID NO: 7312 - protein, 366 aa, Proteus mirabilis
RNNMKAATAVIDRRALRHNFQHVRDYAPHSHLIAVVKANAYGHGLLETAYTLMDDADCFGVARIGEALTLRSGGIVKPILLLEGFFDAVDLPILVVNHIETVVHSEEQLEALENADLEEPVKVWMKLDTGMHRLGVRPEEAEAFYQRLCACKNVQQPVNLVSHFSRADEPDIPEVTQNQIQLFQAFIQDKAGDKSIAASAGILFWPQVHYQWVRPGIITYGISPTGDNRTGKDFGLTPAMTLKTSLIAVRKHKAGEPVGYGGTWVSEKDTYLGVIAIGYGDGYPRSAPSGTPVWINGRKVPIVGRVSMDMISVDLGSELIDRVGDEAILWGDVLPVEEIAKYSGISAYELITKLTSRVIMEYLDEQ

SEQ ID NO: 7313 - protein, 189 aa, Proteus mirabilis
EHLMKKLLLSAIITSAMAIIATPALAEDTGTPAPTEVTVNSGTINFEGSVVNAACGVDSSSSNQTVRLGQFRVAEFTKKGDETGRIPFSIKLNNCDITVSSLAAITFNGTASDGDATAFALQGSGAATNVALKITDSSSKNVVPGQPSSTQKLIEGENQLNYNASLISTDDTVKAGSANVTTNFMVTYS

SEQ ID NO: 7314 - protein, 369 aa, Proteus mirabilis
HELINIYYWVNSMLYYIYVLSGPLKGIITPLLPNQYSLILHSKEHIENKIENEKLTLYIPCNKKEHEKIITIMLDEHNTKNNKYKIEDGLISKEISKELPLELDKPIYINNFPIFLISHKDDLSITSFDLNSKKWTINRKIIVSFIFVIAFFIVSFTFMNVSKPLENKPKELAFKSSYSNEFKGENGYLCIYTEPYSSKNLIKDSDSKTKISFLNKEKIIKLATNNKIHVTLKDNTKPIVSFFYYNKNEKLKIIQAINDNFPKNCQPIIKELSIAKIVEEINKLNFTKTIGYTIEEKNNGLIFIFDDKLSVNDKEKFNAYIKKQAAFFGRKFIFYRENKVNINLKNKAMLQEDNGYIFLDNQHRYFPQG

SEQ ID NO: 7315 - protein, 873 aa, Proteus mirabilis
LAIINSIENKRLFCHFSLLILSQHHRSTKDFLLCFRSIANKRLQLFMSAWRKLYYNTLNLPLKLLVKSKRVPTDPITELGLDTSRSFLYVLPYHSKADLLTLRQQCLSLGLPDPLQPIEINGTKLPAYVFIDDGPRVFRYYSPDPRKDSVKTFHAYLDAHRNNPHLDIEMLPASVMFGRSPGREGHNGVPHLRLLNGIQKFIAILWLGRDSFVRFSPTVSMRQMANEHGTDTSIARKLARVARIHFSRQRLAAVGPKLPARQDLFNKLLASKAIEKAIEDEAKAKKITLDKARKNATDIMEEIAANFSYEAVRMTDRVLSWTWNKLYQGINVFNAERVRQLAQDGHEIVYVPCHRSHMDYLLLSYVLYHQGLVPPHIAAGINLNFWPAGPIFRHLGAFFIRRTFKGNKLYSTIFREYLGELFSRGYSIEYFVEGGRSRTGRLLDPKTGTLSMTVQAMLRGETRPISIVPIYIGYEHVMEVATYAKELRGATKEKEGFMQMIRGLRKLRNLGQGYVNFGEPISLSQYLNQAVPDWRDDIDPIEPQRPSWLNPAVSALADNIMVNINNAASINAINLVSTALLASRQRALTKEQLLEQIDCYLQLLRNVPYSSDMVVPDKSSETLLAHALQTDKFQVEQDSLGDIIILPRESAVLMTYYRNNTIHLMVTPSLIASIVLHHERIHRDDLMKQVELIFPLIKAELFIRYEKEELPDVVNTLISELCRQRLICCADDGILRINPARIRPLQLLAASVRETLQRYGITLSLLNFAPEISRALLERESRILAQRLSVLHGINAPEFFDKAVFSTLVSTLREEGYLKDNEDILKADASALYQVIAKLMSPEIRLTIESVGVTEDNNSAQAIEENPESSMDK

SEQ ID NO: 7316 - protein, 237 aa, Proteus mirabilis
GEVMDNQLIERIVAEIEKRIKKPVLLVLTPAPGYRDEIYQRISHFSTVRASIFVTTQAQQCHDLSQWCHVGDITKADEFDPHRLSAYQALFIPYFDKKLVGEIINGLMISEEGTLIHSALAKNIPIIALPYFCQPNSEINEILGLNQNEHYNLVLKQNIERLISMGITFCSINEVEDNLKKNAFDHKLKFINKTETKQLNNNRYITLKQVMSNPEKYQLSQDKLTDSAIEYLKSLKD

SEQ ID NO: 7317 - protein, 146 aa, Proteus mirabilis
CITIYLGVIMSFDLASLLMDAMNVIGRNDLFSGGKSIDNHSTITISLGDMPDINLLVVDEVPMIWSVLCDYDEKLLTQISAELLLDSINNQTESFYPGQPALVRIEDSLELRASFMPIALQNGESMARAIDDYFQIMNSIHQRFIG

SEQ ID NO: 7318 - protein, 389 aa, Proteus mirabilis
YPAILCSLCSDSTSCSSRIGECNSNLFTGVPIMTRSFSFFTLLVSLLCIPSQMAWAIADPLVVTPPPMNFDGAADGTPAGTPITSTWIGETSVHNGFKCEKKFLQKCWVETLYANATGSKISGIYYYEGSNRYPVYSLPGVKGIGYAFGLKDNNDSVAYVPIDVDNGSGATVIYPAVGSTVNHNVDRVSLKGKVVFVVTDKHLETGVYNIPYTVITNTWSEYGGGHKGNNTSIVAINPVTITIKARGCTVNTKNLTYELGDISMRDMAAIGSTSKSQAKPISVTCDSNVHLYASMTDQSTYSNNTDILTLTSDSDASGIGIQFFFNDNPTPVVYGPDISAIGQPNQRLLHITTSNNENYILNLSTRYITTGTLKPGKANGLASLTFSYQ

SEQ ID NO: 7319 - protein, 216 aa, Proteus mirabilis
DNKMSILFSMEKFITHHIQILAYVINFIAYDFKKFTFAGVPHMASRGVNKVILIGNLGQDPEIRYMPSGGAVANLTLATSESWRDKQTGEMKEKTEWHRVVIFGKLAEIAGEYLRKGSQVYIEGQLQTRKWQDQSGQDRYSTEVVVNIGGTMQMLGGRGGQDNAPSQGQGGWGQPQQPQASQQFSGGAPSRPAQQPAAAPAPSNEPPMDFDDDIPF

SEQ ID NO: 7320 - protein, 575 aa, Proteus mirabilis
GQLMTAEDLVAQTILQGFDAQYGRFLEITSGAQYRFEQADWHGIQLAMKERIRLYDNHVGLVVEQLRCIRHDIDKESVFLQKVKERYTQLLPNYPRFEIAESFFNSVYCRLFHHRELNKKNLFVFSSQPAYRFAQAPRPLSRTFVIQSDLPALLQDILSRLPLRLPWQNKSRDIQFICQTLYAQFSHEELQNAVFHIANELFYRNKAAWMIGKIAINNQFIPLLLPIHNIEQHLVIDTCLTTIDEASIVFGFARSYFMVYAPFPAALVTWLRDILPEKSIAELYMSIGCQKHGKTEYYREYLAFMNFSSEQFIEAPGVKGMVMLVFTLPTYDRVFKVIKDRFAPQKTMTAERVKECYRLVKEHDRVGRMADTQEFENFVIDKKRISNDLMAILEQEIPNKLEDLGDKLLISHLYMERRMTPLNIYMEQCDDKQLKAVVEDHGQALKELIAANIFPGDMLFKNFGVTRHHRVIFYDYDEISYMTDMNFRAIPPARYPEDELASEPWYSVAENDVFPEEFRYFLCCDKQVCHYFEAQHRDLLSPEYWQQQQQRIKQGYIEDVYAYPQSKRFIDNDIG

SEQ ID NO: 7321 - protein, 216 aa, Proteus mirabilis
KIMINQQLMGKILTRLNIPNVGMGINQGIAIPVGISNRHVHLSQQDVDALFGHGYQITPFKDLKQPGQFAAKECVMVVGPKGSISKVRVLGPVRPQSQLEISKADCFALGIKAPVRSSGDLAGSGNAVLMGPAGYVELKQQVICAQRHIHMNNIDARALNVTNGQKVHVKTEGERSLIFDEVIVRVSDKFALEFHIDTDEANAAGVRNNDSVFIVS

SEQ ID NO: 7322 - protein, 89 aa, Proteus mirabilis
RSAFGNAETGAAWLSSARVVKCWVKSRNERNPYPFLPARDGGNSKETAGDKPEEGGDDVKSSWPLRVGLHTCYNGRYKEKRPRESKRNS

SEQ ID NO: 7323 - protein, 73 aa, Proteus mirabilis
IKAFPFIILVVLSSYILIGYSSFKGMHMNNKFPDKIFLSPLIFISFINMVNTSAYTYNLLRVQKNKLFFKMLL

SEQ ID NO: 7324 - protein, 171 aa, Proteus mirabilis
ERKMNSLGVIETRGLTAAIQAADAACKAASVEIIGYRKIGSGLVSVCFQGEISAVKTAVEHGVDVVSQKELVIGSLVIARPEPSVITKLLTIKGKKKSAVISEETQQNALKTLAENRVETVMKHESGDSDATKEVADRLAQNSAPETKAMTADKAPSSKKESKPESRKGKK

SEQ ID NO: 7325 - protein, 218 aa, Proteus mirabilis
LGKIKMNHWNTSAESVLKSGPVVPVIVINHIEEAVPVAKALVAGGVKVLEVTLRTDCAIEAIRRIAKEVPEAIVGAGTVINPQQLAQVTEAGAQFAISPGLTDALLKAAVAGSIPLIPGISTVSELMLGMSYGLNEFKFFPAEANGGVKALKAIAGPFSQVRFCPTGGISPENYRNYLALESVLCIGGSWLVPSDAVKAGDYQRITELAKEAVAGAQH

SEQ ID NO: 7326 - protein, 356 aa, Proteus mirabilis
RSFVIISTGRYNAGLYNPRSIINLIKEITMAKRIQFAAHGNADVLELTSFTPAPLGDNEVQVANKAIGINYIDTYVRSGLYPVEHFPSGLGTEAAGVVIKTGAHVTSLKEGDRVVYAQSPLGAYSDTHNVPENKVARLPDNISFEQAAASFLKGLTVYYLFNETYKLRAGETFLFHAAAGGVGLIASQWAKAIGAKMIGTAGSDEKVAKAKAAGAWKVINYQTESIVERVLALTNNQKVPVVYDSVGKATWLDSLHCLQRRGLMVSFGNASGAVTGVDLGILNKLGSLYVTRPSISGYITTREELDAASEALFTLIGRGKIDVSVPDNQKFALADAKAAHRYLESRQSQGSSLLIP

SEQ ID NO: 7327 - protein, 548 aa, Proteus mirabilis
MKNVNPTHTLAWKALEDHFAVMKDTEMKTLFSQDPSRFDTFSRTFSDQILVDFSKNRITQETLDKLQALAKECDVAGAIKSMFSGEKINCTEDRAVLHTALRNRSNTPVMVDGKDVMPEVNAVLHKMKVFSERVISGEWKGYTGKAITDVVNIGIGGSDLGPYMVTEALRPYKNHLTMHFVSNVDGTHIAETLKKCDPETTLFLIASKTFTTQETMTNAHSARDWFLSAAKESAFVAKHFVALSTNSAEVEKFGIDTANMFEFWDWVGGRYSLWSAIGLSIVLSIGYDNFEQLLSGAHAMDNHFRTTEAENNIPMILALIGIWYNNFFGTETEAILPYDQYMHRFAAYFQQGNMESNGKYIDRDGNKVSYQTGPIIWGEPGTNGQHAFYQLIHQGTKLIPCDFIAPAISHNPLSDHHAKLMSNFFAQTEALAFGKTREQVDAEFASAGKDPATMGYVAPFKVFEGNRPTNSILLKEITPYSLGALIAMYEHKIFVQGVIFNIFTFDQWGVELGKQLANRILPELKGKESVNSHDSSTNNLINRYKAWR

SEQ ID NO: 7328 - protein, 156 aa, Proteus mirabilis; identical to SEQ ID NO: 5578

SEQ ID NO: 7329 - protein, 408 aa, Proteus mirabilis
IKIVTRRCPWLPLLRRFIGTVRSNNDMSEFLIKPKIQFGTNALNFLSGLTARRAFVVTDKAMVKFGFADKVTEKLMQRGIEFQIYDDVASDPDISAIVSGMKIMDAHYPDLVIALGGGSVIDAAKAVMYSLWHTRKEHSRSKPQFIAIPTTSGTGSEVTSFSVIKSRSEKLVLVDEFMLPDIAILDPELVKSVPPAITADTGMDVLCHALEAYVSKAASDFSDAMAEKAVKLVFSHLLDCHHQGDNLLAREKMHNASCIAGMAFTNASLGITHSLAHALGGVFHVPHGRANALLMTHVIAFNANLHGDCNSEAAKRYAYLAQSLGLPAQTVKEGVISLIVAINVLKDEMGMPKSIRDTGVSEADFYARLTEMVGQALRDSCTPTNPRDVNTHQLETLYRQAFAGVSHS

SEQ ID NO: 7330 - protein, 84 aa, Proteus mirabilis
GLSVTANGCNLYLIHSIQIIVPDALKPRPPVYQGGENVKKMQMICKNIKSSAFSVFNLYKKTYVPLTFIFYLLNEAYSHRFFSA

SEQ ID NO: 7331 - protein, 479 aa, Proteus mirabilis
LIFFRLCAGFMARNKTTDKLMSEIKDRQMEGLKLPPHSLEAEQSVLGGLMIDNERWDNVSERVTADDFYSRPHRTIFAQMQRLLELGKPIDLITLSEALEQNAELESVGGFAYLAELSKNTPSAANINAYADIVRERAVVRDMIKVANEIADAGFDPQGRTSEDLLDFAESRVFQIAETRANKDEGPKAIDAILEETVEKIEQLYQKPHDGVTGVSSGYQDLDKKTAGLQKSDLIIVAARPSMGKTTFAMNLCENAAMTEEKPVLIFSLEMPGNQIMMRMLASLSRVDQTRIRTGQLDDEDWARISSTMGILLEKRNMYIDDSSGLTPTEVRSRARRIYREHGGLSLIMIDYLQLMRVPSLSENRTLEIAEISRSLKALAKELQVPVVALSQLNRSLEQRADKRPVNSDLRESGSIEQDADLIMFIYRDEVYHENSDLKGVAEIIIGKQRNGPIGTVRLTFNGQWSRFDNYAGPAYDDE

SEQ ID NO: 7332 - protein, 371 aa, Proteus mirabilis
RNLVMSSILPRSVTSPKKFFIGSQLLASVGNYMKDFGDNAFIISDEFFLEKVNKEALSSIKENGLSGFVEKFNYECTEAEVDRLGKIVVENKANVIIGIGGGKTLDVSKAVAYYHHLPVILFPTIASTDAPCTALSVLYKENGEFDKYLFLPQNPDMVIADTAIIASAPQRFFSAGVGDALATYFEARACYQADGLNLVNQRPSRTGLGLAQLCFEILSENIDKAMDAVRHKITTQALEQTIEATIYLSGVGAEAGGLAAAHAVNNGMSAVASLHHVQHGEKVVFGLLTQLVLENAPQEEIDEVIRIIKAAELPLTLEDMGMKEFIESEWRNVAKIACAEGDTMGNMPMKVTEEDVYNAMIAANALAHRYK

SEQ ID NO: 7333 - protein, 254 aa, Proteus mirabilis
GSIVMNRRYLLLLFLCCLLPLLNGCKDQSLLTNLSQRQATEIQAVLQKHQITSTRTALGKGLFEISVKKENIGIAIQILEEYQLPTISRIEITQLFPSDALVSSPQAEKARLISAIEQRLEQSLLTIDHLIDARVHVSYPLSSNDRITPTPHASALVFYEDGMIDSDQLSDDVRAFIHNAFNDMDESNITVLLYPRNINKFTILNNQLHQDNTTSLSSSWLLIGLSIISLIIIIMVILIIYRRKQVNKMVSENE

SEQ ID NO: 7334 - protein, 256 aa, Proteus mirabilis
AEVFTMLINDIKISGDKNILSGNLLFMCIPLNDEYPIRIYDDKTTKIIKGKAFIYNSKNENVIFQSENQSWRIEKRSFFICARLLAFIDYARDFSKMTAVGTNFDINQQIFYIKEGSGTLEHLIINEALKDESQLEPLFVTIRHSESYWLILHLISYLDEKKSNIAQIGERYGVSGTHFRRLCKRYLGNCGKSQLRSWRAASSILTTLSTDESLTQIAVDNGFSSASHFSNEIKTLFGITPTEFRRIGQYLYEHKK

SEQ ID NO: 7335 - protein, 173 aa, Proteus mirabilis
DSVSLRLPYTVNLATEYKSLTHYTKGTQSPHPQMSRLPLRSILPDFLTSVARVLLGTLRDGLKKSTNLVSKFGAIFGDVLASLSARHLSDGAPTACTYTVSGSFSLPSPGFFSPFPHGTGSLSVNQEYLALEDGPPIFRQDNTCPALLVEFTTTASSDTGLSPFTAGLSRPFS

SEQ ID NO: 7336 - protein, 324 aa, Proteus mirabilis
IQASRCLDVFLEVIEMPIRVPDELPAVSCLRNENVFVMTSSRASIQDIRPLKVLLLNLMPKKIETENQFLRLLSNSPLQIDIQLLRIDSRVPKNTPVEHLDTFYCDFAQIKEQNFDGLIVTGAPLGLVEFEDVAYWEEIKEIITWAKEHVTSTLFICWAAQAGLNILYDLPKYTLKQKISGVYRHTTCDPFALLTRGFDETFFAPHSRYAGFPVEFIQQNTDLEILATSEQAGAYLFASKDKRVVFATGHPEYDPNTLADEYHRDVKAGLAPQLPENYFPDNNPNKKPLVSWRSHGHLLFANWLNYYVYQITPFDLAQMNPTLD

SEQ ID NO: 7337 - protein, 170 aa, Proteus mirabilis
RKYSATVVATKAALHLSTADCSEVEQIKTVFSHRLCCFNSSINSVTSLPRSPIKPITKTSACAKRIIIFINIVLPVPALAKIPIRCPNPQLNNPSIARIPDLNSVVIGSLSLNKGGRPSIGHKVLKVFSAISVLNRNKQFPLLSIMLPNICGPRATENVFPVGSTIICKE

SEQ ID NO: 7338 - protein, 72 aa, Proteus mirabilis; identical to SEQ ID NO: 5059

SEQ ID NO: 7339 - protein, 198 aa, Proteus mirabilis
SLMLKNPIHLRLEKLESWQHLTFMACLCERMYPNYQVFCRETGFTDPTLYRRILDLVWETLTVKDAKVNFDSQLEKLEEAIPDASQFDIYGVYPAIDACVALSELIHSRLSGESLSHAIEVSKISVGTVATLEMTQAEREMSEEELKSLAAVTEEFDIQWEIYRLLVECEERDIELIKGLRTDLRESGMSNIGIELTH

SEQ ID NO: 7340 - protein, 382 aa, Proteus mirabilis
PINPIFRGFLMKTFSDYWQQLDWDDITLRLNSKTCEDVETALSHHTLTLDDFMALISPAGRHYLEPMAQRAQQLTRQRFGNVVGLYVPLYLSNLCANDCTYCGFSMSNAIKRKTLNENEILAECHSIRQLGFDSLLLVTGEHQRKVGMDYFRQYIPLIRQQFSLLMMEVQPLATNEYAELKTLGIDGVMVYQETYHEPTYQLHHLRGKKQDFHWRLQTPDRLGQAGIDKIGLGALIGLSDRWRTDCYMVAEHLLFLQKRYWKSRYSISFPRLRPCAGGLNPASVMSEAELVQLICAFRILAPDVELSLSTRESPYFRDNTVPLAINNISAGSKTQPGGYSDSHEELEQFSPNDNRHVSDVINALKTRGLQPVWKDWDNYLGR

SEQ ID NO: 7341 - protein, 231 aa, Proteus mirabilis
IRFTRMTNITKHKIAIFDLDETLLAGDSSCLWTNYLWEKKRVTDPAFLALDKQMIADYYAERLNINKYLHQHLSYFNQHNIEEINQWVTDFTHTIIKPLLYPQGINTINLYRQQNIPVIIISATMSFLVHAIAKQLNADISMGIDMQIKNNHYTGHIEGIPTFREGKVTRLNQWKEQNNINNSYIYFYTDSANDLPLCYQANEVITINADERLSQIATEKEWQQCYWQLNK

SEQ ID NO: 7342 - protein, 1433 aa, Proteus mirabilis
LHWFKGVNDRGHLPGRSNSDRSHFVKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRERMGHIELASPVAHIWFLKSLPSRIGLLLDMPLRDIERVLYFESYVVVEGGMTSLERGQILTEEQYLDALEEFGDEFDAKMGAEAVQNLLQSMDLEQECETLREELNETNSETKRKKLTKRIKLLEAFMQSGNKPEWMILTVLPVLPPDLRPLVPLDGGRFATSDLNDLYRRVINRNNRLKRLLDLAAPDIIVRNEKRMLQESVDALLDNGRRGRAITGSNKRPLKSLADMIKGKQGRFRQNLLGKRVDYSGRSVITVGPYLRLHQCGLPKKMALELFKPFIYGKLETRGLATTIKAAKKMVEREEAVVWDILDEVIREHPVMLNRAPTLHRLGIQAFEPILIEGKAIQLHPLVCAAYNADFDGDQMAVHVPLTLEAQLEARALMMSTNNILSPASGDPIIVPSQDVVLGLYYMTRDCINAKGEGMVLSGPKEAERVYRAGLASLHARVKVRITEEIKDGEGNITTETSLKDTTVGRAILWMIVPKGLPYALVNQPLGKKAISKMLNTCYRVMGLKPTVIFADQIMYTGFAYAARSGASVGIDDMVIPAKKAEIIAEAEAEVAEIQEQFQSGLVTAGERYNKVIDIWAAANERVAKAMMENLSTETVINRDGEEEQQVSFNSIFMMADSGARGSAAQIRQLAGMRGLMAKPDGSIIETPITANFREGLNVLQYFISTHGARKGLADTALKTANSGYLTRRLVDVAQDLVVTESDCGTTEGVMMTPVIEGGDVKEPLRERVLGRVTAEDILKPGTADILVPRNTLLNEKLCDLLEENSVDSVKVRSVVTCDTDFGVCAKCYGRDLARGHIINKGEAIGVIAAQSIGEPGTQLTMRTFHIGGAASRAAAESSIQVRNKGTLKLINAKFITNTAGKLVITSRNTELRLIDEFGRTKESYKVPYGAQLSKGDGEAVNGGETVANWDPHTMPVVSEVSGIIRFADMVDGQTITRQTDELTGLSSLVVLDTAERTGSGKDLRPALRITDAQGNDVLIPNTDMPAQYFLPGKAIVQLDDGVAINAGDTLARIPQESGGTKDITGGLPRVADLFEARRPKEPAILAEISGIVSFGKETKGKRRLVISPLDGSDAYEEMIPKWRQLNVFEGEVVERGDVISDGPESPHDILRLRGVHAVTRYITNEVQEVYRLQGVKINDKHIEVIVRQMLRKVTIENAGSSEFLEGEQVEYARVKVSNRILEEEGKVPATYSRDLLGITKASLATESFISAASFQETTRVLTEAAVAGKRDELRGLKENVIVGRLIPAGTGFAYHQDRIQRRQQQLPTDETEATISADEASANLAELLNAGFGGSSNN

SEQ ID NO: 7343 - protein, 127 aa, Proteus mirabilis
ILGTIVMSISKDDILNAVAEMSVMDVVELITMMEEKFGVSAAAAVAVAAGPAEAAEEKTEFDVILKGIGGNKVAVIKAVRGATGLGLKEAKDLVESAPAALKEGVSKDDAEALKKALEEAGAEVEVK

SEQ ID NO: 7344 - protein, 265 aa, Proteus mirabilis
LALAKVLVMSLILGTVFIKMFHQRMLEHLLMRFTVYRSLIIRIMINTQQLRQEQTEKAQQIILTDQFMAPTYIAGADVGFENSGAVTRAAIVIMHYPSFEIVEYQIARIATLLPYIPGLLSFRECPALLEAWQGIKQKPQLVFVDGQGIAHPRRLGVASHFGLLADIPTIGVAKSRLCGDDKKLDDDVGSTEKLMDKDEQLGWIYRSKKRCKPLYISPGYKVSMESALAWVKRCINGYRLPEPTRWADGIASNRRLFEQLNKNKL

SEQ ID NO: 7345 - protein, 363 aa, Proteus mirabilis
LSLYFSDIYDNFLLSKRSFFSVSWRSTFSTESAMNKPILISSHDAAFKRFMMNISNAKDFFFIHLSDELKSYCDFSTLKLQNSSFIDIKLRSRMSDILYSVKTKTGNISIYFLIEHQSRPDKMIAWRMMHYAFCTMNQHLQQGYTSLPLVVPILFYHGKRKPYPFSVNWLDCFPLSTLANQLYLNNFALIDLNSIDDEILLTHRKAAVMEIAMKHVNSCDDLDKLAMLLSKAINQKNCSDEDTIAVVQYLFSIMDAADFESIINKIAEQVDNHRETIMNIAWRLENKGFKLGKMEGIEIGKNEGIEIGKNEGIEIGKNEGIEIGKKIVQIQLAKNLLKENVELEFIERITGLSIQELKILLLT

SEQ ID NO: 7346 - protein, 115 aa, Proteus mirabilis
RAVQLSLPFPVFCVVARRCILHFPHSVSSANLLGFSLFILFSQPVRLAPCAVTTRTHYREFSEAGNSFFKKKIRLLNSTAKPLVIRSYQQFYPQAIFSHKFSMSNANVCVIIIPK

SEQ ID NO: 7347 - protein, 238 aa, Proteus mirabilis
WRTNLMAKLTKRMRNIREKVDVVKQYEINEAVALLKELATAKFVESVDVAVNLGIDARKSDQNVRGATVLPHGTGRSVRVAVFAQGANAEAAKEAGAELVGMDDLAAKVKAGEMDFDVVIASPDAMRVVGQLGQILGPRGLMPNPKVGTVTPNVAEAVKNAKAGQVRYRNDKNGIIHTTIGKVDFNEAQLKENLEALLVALKKAKPSSAKGVYIKKVSLSTTMGAGVAIDQASLSATV

SEQ ID NO: 7348 - protein, 143 aa, Proteus mirabilis
LMAKKVQAYIKLQVAAGMANPSPPVGPALGQQGVNIMEFCKAFNAKTESVEKGLPIPVVITVYADRSFTFVTKTPPAAILLKKAAGVKSGSGKPNKEKVGKVTTAQVREIAETKAADLTGADVEAMMRSIEGTARSMGLVVED

SEQ ID NO: 7349 - protein, 1388 aa, Proteus mirabilis
FKSNSNKYYGKFYFPTYKKTVLDECRVTLNNKGRQSGSLFSELRNPMVYSYTEKKRIRKDFGKRPQVLDVPYLLSIQLDSFQKFIEQDPDGQNGLEAAFRSVFPIQSYSGNAELQYVSYRLGEPVFDVKECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPATIILRAMNYSTEDILNLFFEKTTFEISNNKLMMTLVPERLRGETASFDIEANGKVYVEKGRRITARHIRQLEKEQIERIEVPVEYIAGKVVARDYIDEATGELICAANMEISLDVLARLSQAGHKTIETLFTNDLDHGAYISETIRVDPTNDRLSALVEIYRMMRPGEPPTREAAENLFENLFFSEDRYDLSAVGRMKFNRSLGREEVEGSGILSQEDIIEVMKKLIDIRNGKGEVDDIDHLGNRRIRSVGEMAENQFRVGLVRVERAVKERLSLGDLDALMPQDMINAKPISAAVKEFFGSSQLSQFMDQNNPLSEITHKRRISALGPGGLTRERAGFEVRDVHPTHYGRVCPIETPEGPNIGLINSLSVYAQTNEYGFLETPYRVVENNAVTDEIHYLSAIEEGNFIIAQANSVLDDDGHFVEELVTCRHKGESSLFSRDQVQYMDVSTQQVVSVGASLIPFLEHDDANRALMGANMQRQAVPTLRGDKPLVGTGMERAVAVDSGVTAVAKRGGTVQYVDASRIVIKVNEDETYAGEAGIDIYSLTKYTRSNQNTCINQTPCVSLGEPVERGDVLADGPSTDLGELALGQNMRVAFMPWNGYNYEDSILVSERVVQEDRFTTIHIQELACVSRDTKLGPEEITADIPNVGEAALSKLDESGIVYIGAEVKGGDILVGKVTPKGETQLTPEEKLLRAIFGEKASDVKDSSLRVPNGVSGTVIDVQVFTRDGVEKDKRALEIEESQLREVKKDLTEELRIFEAGLFARIRGVLIAGGIEADKLDKLPRERWLELGLADEEKQNQLEQLAEQYDELKAEFAKKLEAKRRKITQGDDLAPGVLKIVKVYLAVKRQIQPGDKMAGRHGNKGVISKINPIEDMPYDENGNPVDLVLNPLGVPSRMNIGQILETHLGMAAKGIGDKINAMLKQQQEVAKLREFIQKAYDLGMAPRQKVDLDTFSDEEVLRLAENLKKGMPTATPVFDGAEEMEIKEMLKLADLPTSGQITLFDGRTGEQFERPVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 7350 - protein, 171 aa, Proteus mirabilis
SRSKKLMALNLQDKQAIVAEVSEVAKGALSAVVADSRGVTVDKMTELRKACREAGVTVRVVRNTLLRRAVEGTSYEVLKDAFVGPTLIAFSSEHPGAAARLFKDFAKANPAFEIKAAAFEGEFIPGSNIDRLATLPTYEEAIARLMSTMKEAAAGKLVRTLAALRDQKEAA

SEQ ID NO: 7351 - protein, 115 aa, Proteus mirabilis
LSKKDELSFFTRCFSNDKTYFKDYFMNKAELTESVAEKADLTKTQAKAAIEAFIDSVTGALKEGDSVQLVGFGTFKVNHRAERTGRNPQTGKEIKIAAANVPAFTAGKALKDAVK

SEQ ID NO: 7352 - protein, 217 aa, Proteus mirabilis
LIMNRSSNSAFAPTEKKLGLYPVVDSIEWVERLLKIGVTTIQLRIKDKQPKDVEQDIITAIKLGRKYNARLFINDYWELAIKHHAYGVHLGQEDLDIADLDAIKQSGLCLGISTHNDTELQRAKRLLPSYIALGHIFPTTTKDMPSKPQGLRALKHQVEQTHDFPTVAIGGISLEKVSDVVATGVGGVALVSAITKASDWQQVTLKLLELVEGKPSC

SEQ ID NO: 7353 - protein, 385 aa, Proteus mirabilis
RCCLPTVIFPTCYTTRYFAALLLLMELDMSELKNDRYLRALLRQPVDVTPVWMMRQAGRYLPEYKETRAQAGDFISLCKNTELACEVTLQPLRRFPLDAAILFSDILTIPDAMGLGLYFETGEGPRFKTPINSLDDIKKLPIPDPEDELGYVMNAVRAIRHALQGNVPLIGFSGSPWTLATYMIEGGSSKAFTKIKKMMYSEPQALHLLLDKLADSVILYLNAQIKAGAQSIMIFDTWGGVLTGRDYQLFSLQYMHKIVDGLIRENEGRKVPVTLFTKGGGRWLEAMAATGCDALGLDWTIDIEDARRRVGDKVALQGNMDPSMLYAPPARIEQEVATILAGFGKGTGHVFNLGHGIHQDVPPAHAGAFIDAVHRLSKPYHQDND

SEQ ID NO: 7354 - protein, 67 aa, Proteus mirabilis; identical to SEQ ID NO: 5360

SEQ ID NO: 7355 - protein, 141 aa, Proteus mirabilis
PTTRIASGDAITTSKSISPALTLAAKSSIPTNSAPASLAASAFAPCANTATRTERPVPCGRTVAPRTFWSDLRASMPRLTATSTLSTNLAVANSFNKATASLISYCFTTSTFSRILRMRLVSLAIRLVLHYQAHGTSSTFN

SEQ ID NO: 7356 - protein, 243 aa, Proteus mirabilis
STERRSKIIPLNGMNNRGGVAPLLLRRQGLLAIGFSFLLSACSSSPQLPEFSATGYIADEGVVRLWRLNNKTSEPQVIMSVYSFYQKPETVVTFYEYRQNRLWQIRSEIVNPSHPSSWHLRLNKRGEVIFMQQEYQGQKRPLTEDERLKMVFAASREREISKALAIGQVKLVQGTWYQDTLTTCAGEKVNVSFEAPEQRWLKRRTQHLTRPAYVAWLDSPEGNQLLMVAEHDFCKWEPTKESL

SEQ ID NO: 7357 - protein, 130 aa, Proteus mirabilis
NRNGQRRKSERKFFPGYVLVQMVMNDATWHLVRNVPRVMGFIGGTSDRPAPISDKEVDAIMNRLQQVGDKPRPKTLFEPGEMVRVSDGPFADFNGVVEEVDYEKSRLKVSVSIFGRATPVELDFSQVEKG

SEQ ID NO: 7358 - protein, 656 aa, Proteus mirabilis
YLLGNAMSKNQTISIKDVSPTANKQRPRKEQRDAAQSFISTIQGINFPNSKRIYITGTRSDIQVPMREIQLDKTLIGGSKEDPIFEENEPIPVYDTSGPYGDPTSQLDVNLGLKKIRQPWIDARNDTEPLSHLSSDFTQQRLTDAGLEHLRFPLKPSPRKALNNKRVTQLHYARKGIITPEMEFIAIRENMGRERIRSEVLRQQHAGFSFGAHLPDNITPEFVRQEVAAGRAIIPANINHPESEPMIIGRNFLVKVNANIGNSSVTSSIEEEVEKLIWSTRWGADTVMDLSTGRYIHETREWIIRNSPVPIGTVPIYQALEKVNGIAEDLTWEMFRDTLLEQAEQGVDYFTIHAGVLLRYVPMTAKRLTGIVSRGGSIMAKWCLSHHKENFLYTHFREICEICTAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPETARQYHDETLPQASGKVAHFCSMCGPKFCSMKITQEVRDYAAGMEQMSQAFKAHGSELYHSAEIASSEVADNEQIL

SEQ ID NO: 7359 - protein, 81 aa, Proteus mirabilis
RWTGTLGLPACGFFTRIIVTYVSIRTSDTSSIPHSTPSQAYRTLPYPTTLCVAAAASVHGLAPLHLPRGPTRPVSYYAFFK

SEQ ID NO: 7360 - protein, 266 aa, Proteus mirabilis
DRIITMHLYTLTGGEKGWWTVSLGGRVWLPKGELPFGLATDWGLVGKQAKIVGEWQGENVWLIYDKMESDMCSPRLIASQDEKLFKLVGRGVQLAEFYRSHRFCGYCGAKMRHSESEWACLCDNCHERYYPQIAPCIIVGIRNKDKILLAHHVRHKHSPLYTVLAGFVEVGESLEDAVAREVFEESHIHIRNIRYVSSQPWPFPHSLMMGFLADYAGGELRHDPSELISAAWYRYDELPQIPPSDTIARRLIEDTIANIRQDEENS

SEQ ID NO: 7361 - protein, 432 aa, Proteus mirabilis
GIAMKILIIGNGGREHALAWKAAQSPLATQVFVAPGNAGTALEHGVQNVDISATDIAALVAFAQQNHIDLTIVGPEAPLVIGVVDAFKQAGLMIFGPTKGAAQLEGSKAFTKDFLARHHIPTAAYQNFTEIAPALEYLHKVGTPIVIKADGLAAGKGVIVAMTHTEAENAIKDMLAGNAFGDAGHRIVIEEFLDGEEASFIVMVDGENVLPMATSQDHKRVGDGDSGPNTGGMGAYSPAPVVTPEIHQQVMDNIIYPTVKGMAAEGHRYQGFLYAGLMIDKQGIAKVIEFNCRFGDPETQPIMMRMQSDLVDLCLAGAKGELAGKDSIWDPRPALGVVMAAGGYPDNYRQNDIIEGLTATSSSTAKVFQAGTKLTAQGEVVTAGGRVLCATALGEDIEQAQKNAYALAKSIHWYGCFYRHDIGYRAIARLKK

SEQ ID NO: 7362 - protein, 259 aa, Proteus mirabilis
IIRISRGKTIMLNDNDFMRYSRQVMLEDIGLEGQTKIQQARVLIIGLGGLGSPASLYLAGAGVGELILVDDDNLHVSNLQRQILYRTQDIPDAKSDIAKQALLALNPDIKITTYKQRVNDDFLSTLLQNIDLVLDCTDNMSTRQAINRICVKQQIPLISGSAVGFSGQLIVFEPPFIHGCYHCLYPDNKEPQRNCQTAGILGPVVGVIGTLQALEAIKLLAGLPSTLSGKLRLFDGRKQNWSTLRLTPSKNCPVCRGLA

SEQ ID NO: 7363 - protein, 569 aa, Proteus mirabilis
VRLILSSSSEMLVVQTQFHCINVTFHHNDYCYTKTQGIKLMQHLRPIRRALLSVSDKAGILEFAKALVERNVELLSTGGTARLLAEAGLPVIEVSDYTGFPEMMDGRVKTLHPKVHGGILGRRGQDDTIMEEHDIRPIDMVVVNLYPFAKTVARPDCSLADAVENIDIGGPTMVRSAAKNHKDVTIVVNSNDYEKVIEEMDNHQNSLTLDTRFDLAIKAFEHTAAYDSMIANYFGQKVAPYYGDTSQPSGTFPRTLNLNYIKKQDMRYGENAHQQAAFYIEENIEEASIATANQLQGKALSYNNIADTDAALECVKSFSEPACVIVKHANPCGVAIADTLTQAYDNAFKTDPTSAFGGIIAFNRSLDAKTASAVIERQFVEVIIAPSINEDALPILATKPNVRVLACGEWQEAKPALDFKRVNGGLLVQDRDLGMVKEENLRVVTQRQPSEREWKDALFCWKVAKFVKSNAIVYAKNDMTIGIGAGQMSRVYSAKIAGIKAADEGLEVAGCAMASDAFFPFRDGIDAAAMAGVTCVIQPGGSIRDDEVIAAANEHNIAMIFTNMRHFRH

SEQ ID NO: 7364 - protein, 89 aa, Proteus mirabilis; identical to SEQ ID NO: 5555

SEQ ID NO: 7365 - protein, 151 aa, Proteus mirabilis; identical to SEQ ID NO: 6296

SEQ ID NO: 7366 - protein, 276 aa, Proteus mirabilis
SMRVTQFFSFKQLREADMLKIADTTFTSRLFTGTGKFATPTLMAEAIKASGSQLVTMAMKRVDLKNGNDDLIAPLKSLGVKLLPNTSGAKTAQEAVFAARLAKEAFDTHWIKLEIHPDTKYLLPDPIETLKAAELLVKEGFVVLPYCSADPVLCRRLEEVGCAAVMPLGSPIGSNQGLQTRDFLRIIIEQTSIPVVVDAGIGAPSHALEALELGADAVLVNTAIAVAKNPVLMAQAFKAAIDAGELARQSGLAVPTAITHMQAQASSPLTQYLEAF

SEQ ID NO: 7367 - protein, 88 aa, Proteus mirabilis
KTKLEHLALNTIKKLSCLSRVSMNITVNDERYSLDMPVTISQLLIELKQPSMGVALAINDIIIPRENWNTQMINEGDTILLFQAIAGG

SEQ ID NO: 7368 - protein, 115 aa, Proteus mirabilis
DSVSLRLPYAVNLATEYKSLTHYTKGTQSPHKEAPTACTYTVSGSFSLPSPGFFSPFPHGTGSLSVNQEYLALEDGPPIFRQDNTCPALLVEFTITASSDTGLSPFTAGLSRPFS

SEQ ID NO: 7369 - protein, 84 aa, Proteus mirabilis
KVGSGEKPVTPRPGLVLESKIKEKKLLLIKNCIVPPINHITIKASINFDVSIFFFKQYMNEKETVNNEIYVAVFLIKSDNKKYF

SEQ ID NO: 7370 - protein, 384 aa, Proteus mirabilis
CEVSHYIPTDKDRVITMKNVGFVGWRGMVGSVLMQRMVEERDFDGINPVFFTTSQLGEAAPAYGNHRSTLQDAYDIDTLASLDIIISCQGGDYTHDIYPKLRQAGWQGYWIDAASALRMNDDAVIILDPVNGQHIQDSLNKGIKTFVGGNCTVSLMLMSLGGLFANDLVEWASVSTYQAASGAGARHMRELLSQMGALHNQVVKELENPASAILDIERKVTNFTRSGTMPTEQFGVPLAGSLIPWIDKQLENGQSREEWKGQAETNKILNTGSNIIPVDGLCVRIGALRCHSQAFTLKLKKDLPVNEIEQLLAQHNDWVKVVPNDRELTMRELTPAAVTGTLSTPVGRIRKLNMGPEFISAFTVGDQLLWGAAEPLRRMLKILA

SEQ ID NO: 7371 - protein, 91 aa, Proteus mirabilis
PSLSPNAIFLNGRNLVLIKIEPVKLILSSIAILFIAIFSIYISTSYYITYFLMEDRILFSFQTGLLVFATPLILYFSYYSFILGYQKSYKE

SEQ ID NO: 7372 - protein, 148 aa, Proteus mirabilis
KWSSGSGSPSCERPRSSDRFFEIIKANHSVVKLAFPRELRLLTPKHFNFVFQQPQRASSPEVTILGRQNELGHPRIGLTIAKKNVKRAHERNRIKRLAREYFRLHQHQLPAMDFVVLVRKGVAELDNHQLTEVLGKLWRRHCRLAQKS

SEQ ID NO: 7373 - protein, 87 aa, Proteus mirabilis
IMASSLSLGSKILILLIRGYQLGISPLLGPRCRFNPTCSHYGIEALRRFGMIKGSWLTVKRILKCHPLHEGGDDPVPPRKNDDNREN

SEQ ID NO: 7374 - protein, 170 aa, Proteus mirabilis
IDLPVGGKIIVLCIRIYKEYMMKKLLFPSLLVLSTVSGTVQAANHAVVEVYKTENCGCCNLWADGVKEAGFDVNVNIVSETELMQKYQQAAVPDNLLSCHYATYQGKDLVGHIPIDSLKNIDLMDKKQIGIAVAGMPAGSLGMYAGDYKEPYQVIAFDKAGNQSLFKSYN

SEQ ID NO: 7375 - protein, 61 aa, Proteus mirabilis
IMTLLAFDNNAWFILIITIDLFLTIRFLRQKKTDNRIFDYLLLKTSLMTTNTTYVKGLNCF

SEQ ID NO: 7376 - protein, 143 aa, Proteus mirabilis
MFKPISEPIMKKILVLLIGSTLAFASQANSNQQNSGGFVAPQSAITTTEQGGFKGPSISETTVAKAKTLSDDTWVILTGKITKKIGDELYVFEDTTGAINVEIDQKRWRGQTVTPENTVKIEGKIDKEWTSTEIDVKQLSIVK

SEQ ID NO: 7377 - protein, 110 aa, Proteus mirabilis
QGVPAKKLHYFLQHRMQSLSLVKNSIKEPKYTFVMAQLQPIPSFLFQFLRKVSQQSFFLLTDLCTISAEKSCKTAFKRVSLFTLPDLSSGKLLRNQHSSSKPVTKIVTRT

SEQ ID NO: 7378 - protein, 418 aa, Proteus mirabilis
KCTPTHCFSLYLATFSTTITTGIKNRMMKIAYLDPYPVPDLRVASLQILQNVDAFARAGAQVTLVTPKGQYRDSDILGRDIHSNARLIALRDIRRKWYFPFNSQKLFSLQIARWLKQHPVDALFTRNLKLACYLAENHADIPLFFESHEIFAQSFAESHSFETKKNRLKYHKLLKMEKLVYSRATAVFVLTSLLRDDIISQYQVTTPITIVPDGVDLYAADSNKDSHRDITATTNNVTEVLYLGSLHKWKGIPTMMRAMKYLDNARLNIAGGTAEQIKGLQLLAKEMDVKEKVNFLGFIDPKQRFQAIAQHDICVLPLTLTSIGSRYTSPLKLFEYMAMRKPVVISDFPSIRDVVDEKAVSFADSGDAQSFAQQIKLLREEPQRTSEKINHARSLVENYYNWDKRAETILHTINKLIS

SEQ ID NO: 7379 - protein, 296 aa, Proteus mirabilis
NKQLHMKILEYYFKQLRTLAQPDRVYLKNKFIRNLGYQPNFRHPMSLNEKINARMLFDRDPIYTRLADKISVREYVKEKIGEKYLVKILNTYRHPNEIELNTLPNRFVLKCNHDSGSTIICLDKSQFDLEMAKKKLNFHLKRNLYHVTREWHYKNISAQIICEEYIDLFDTQCPMIPTTCRIHCFHGQPHYAEIDISDTKGCEYINVYDTQWQLQPFTLEDPNTPEYIEKPLQFDNMLTLANKLANGFAYCRVDFLMSETTLLFSEMTFTPNAGRIPIKPKEWDYKLGELWTPIAS

SEQ ID NO: 7380 - protein, 459 aa, Proteus mirabilis
LSEFTMHSTDTIVAQATPPGRGGVGILRVSGPKAAVVAQTILGKVPKPRYADYLPFRNEDNSVLDQGIALFFPNPNSFTGEDVLELQGHGGPIILDLLLKRILQIPGIRIAKPGEFSERAFLNDKLDLAQAEAIADLIDASSEQAARSAINSLQGAFSSHINEMVESLTNLRIYVEAAIDFPDEEIDFLSDGVIEGKLNTVISQLDDVRAQARQGSLLREGMKVVIAGRPNAGKSSLLNALAGREAAIVTDIAGTTRDVLREHIHIDGMPLHIIDTAGLREASDEVERIGIERAWQEIEQADRVLFMVDSTTTEATTPEEIWPEFMARLPSTLPVTIIRNKSDLTGEPAEITSQGDYPMIRLSARDGMGIELLRSHLKEAMGFNSNTEGGFLARRRHLQALNTAAEHLQQGYQQLVYAKSGELLAEELRLAQQALSEITGEFTSDDLLGRIFSSFCIGK

SEQ ID NO: 7381 - protein, 296 aa, Proteus mirabilis
IMDTRLLNAFVVLADTGHFGEASKQLCISQPALTKQIKTLESQLDIVLFERGRHGAKLTQEGQYLLNQAQVVLRESHILEKQARQLVEPQKVSLYAGFGLSSLSFITSLLARFNQIEPNISVNIDDMSSHKMEEKLLMGELDVAFSRLPVMPPLQGIALTQEQLMLAIATQHITVLEADYNPLHYFDSLELILLAPEKGKKLYQQIHAFLQQHKLAPRLLQQSQDIQTQLALVAAGLGIALVPKSAQLICDKQRVTLLPLSGLYTQWKIGVIWNSNIKNKERDLFIKIITEKIDIK

SEQ ID NO: 7382 - protein, 101 aa, Proteus mirabilis
KDITRPVIAVIVRLILALNKVHFLCFYRIHFMKQKPTAYFPNLVLEEGSISSQVYYAVRKAIYLLVAGRALLLRIPFLIALIPISGLKQPCRRLHCISIMN

SEQ ID NO: 7383 - protein, 1021 aa, Proteus mirabilis
VGNTMHVVLFHKRTLVSMMVSLSLFSLNSYSKTKDNTTDLGQIQVADNLEKDQQGYAQVYEKYVANIYLGKALIERYQGVSRADLFKSAIGVHSGEARNVGALDPNISGIQGLGRITVTVDGSEQAITVYRGYSGASNRTYTDSNLISSIYIEKGPSLNPNIKTGIGGGVAIKTLDIRDIVPIGESFGINFKGDISNNATGYKDIYTNMIEEYRYYPKFYQQNAYIIDPALEITPKKSKIENFQDYSFRLGVGFEKEKFNLLFAYAIREKGNYFAGKRNVEEYSKVDEQLLNSVYIMDGKRHFEPYLPFIAHIYRPGNEVPNTSNRNRSFLVKGTLFPQQTHRFSINYRYTDLLFGDIMPSRLSWVRYQENLVNQWPLANITQQAGILTYQYKPEDKKTDLLLRLWGNLTLGHTNTRGGKPREPKMVDFRASRNTRWDPSIDTGFLDTASLYQDNNRYGVDFSSLFKLSPQFSISFSGQYQLEKLDSHELELPMGFDFVTEGRAGQRHEVNLALATDWKPLPWFAMNIGGKYHYYHLTDTFLNNKRKNRVKNYEKTAPIRGYLISYRRVLTPEEYLLYRAVNKIDVDTLPDELKNYRSSAELSKKIRDFQQAVLVYPEGGALLEEIKEQVARPYLQRIQHDMEHEDFLRNNHGKMQIKNAKAIPMKREFSLWLFDENGVLLKSKNILLNGFLDMEEKVPHPVTGELVYRFEKDVINPQAFSLSEDIQDPYALEPSYQHGAFSPLISATLYANDMVRFYGRYTEQLRLPNLFEDTSGFSGSKARYYGFKLKPERAKSSEFGVVVDFTHWLNIERHADIKINYFKTNIENVFDRDANWQIRQLEKQILEGVELQARFDNGFIFFDTALVYSHKNKVCDENAFYELDASGLSGIKNCMTGGYPGGFLRTSMQPKYSVNLHLGTRWLNDKLELGSRWLYSSEVENKDEKWLKENLPNSYFGINNNPMRWAKVFTIDAYATYQYSPNLSFEITGSNLLNEYYIDPLTRSGMPAPGRSLRLGVTAQF

SEQ ID NO: 7384 - protein, 188 aa, Proteus mirabilis
WYLTMHAQAKVTLAELKECLQAEYIGDKKPFSWLRLFHRVFFCQRSRYLFWWRVAQYFYFSPHRFLHKLGIRIGASNNRKYCNDISLKTRIGKGLSLPHPIGIVLTNYCQLGEYVTIMQGVTIGVKEKGGKANIQVGNHVYIGCNSSIIGGEINIGDNAIIGAHALVLKDVGEGCRYITKVIADIRQV

SEQ ID NO: 7385 - protein, 819 aa, Proteus mirabilis
HGPTVASLAPTFGRGAMTNHWVDMKNANLIVVMGGNAAEAHPVGFRWAMEAKIHNKAKLIVIDPRFTRTASVADFYTPIRSGTDITFLSGVILYLLENKKYQKEYVEAYTNASLIVREDYHFDDGLFSGYDPEKRQYDKTTWNYEMDENGFAKRDTTLQHPRCVWNLLKEHVSRYTPDVVTQICGTPKEDFLKVCEYIAETAAKDKTASFLYALGWTQHTVGAQNIRTMAMIQLLLGNMGMAGGGVNALRGHSNIQGLTDLGLLSQSLPGYLTLPSEKQTSLETYLAANTPKPTVQGQVNYWGNYPKFFVSMMKTFYGDHAQRDNDWGFSLLPKWDKPYDVLQYFEMMDKGEVNGYICQGFNPVASFPNKNKVIRSLSKLKFLITMDPLNTETSCFWQNHGEENDVKTADIQTEVFRLPTTCFAEENGSIVNSGRWLQWHWKGADAPGIALPDGEILSGIFHRLRQLYKEEGGAMPEQVLNMTWDYFDPNNPTSEEVAQESNGKALVDLKDADGNIILKKGQQLSSFAQLRDDGTTASGCWIFAGSWTEKGNQMANRDNSDPSGLGNTLGWAWAWPLNRRIIYNRASADPQGQPWDPKRKLIEWDGSKWTGIDVPDYSNAAPGSDVGPFIMQPEGMGRLFAIDKMAEGPFPEHYEPIETPLGTNPLHPNVVSNPAARVFKDDWEEMGKAEEFPYVGTTYRLTEHFHFWTKHALLNAIIQPQQFIEIGERLAAEKGISQGDTVKVSSKRGYIKAKAVVTKRIRTLDVDGRKVDTIGIPIHWGFEGVAVKGFIANTLTPFVGDANTQTPEFKAFLVNVEKV

SEQ ID NO: 7386 - protein, 112 aa, Proteus mirabilis
NLKTRRFTMGFIMHFRYRKMIFLLLAYLINNNLALADNKNIEFDIDSLKSLGYGSEIADYFKEGSHFLPGYHDVTIIVNSSLNYSDNILINESGNLCLNNQLIDKLKLKKKR

SEQ ID NO: 7387 - protein, 132 aa, Proteus mirabilis
EYRTVTLLKAKSEAILSLTEDLRKYSFTMNTIESTTKRTAVVFPKHKKVLSILGENLTLAMKRRGITQEMMHNRTGLSKPTLRKILKGDPSVSLGHYVNVLASLGLLEDLTKVAFDDELGRKLQDIQLLKKK

SEQ ID NO: 7388 - protein, 489 aa, Proteus mirabilis
SDHAMLTLSTIDMLLAINEGQLIEEVIITLLASPQLAVFFEKHPRLKKALLKDIYQWKKSLQEKVKETLVPTIIADEFALYQQTQSLCNAVFNQQVDNILTELNQLDSSFVIEATQLIKTNKPFSPAQQALFIQRWRISLIFQVTTLHKALFEQEQEQLLAELQERLALSGSLSNTFSENERAAGRLWDMSKGVITKTPYDEKIIQRYSDFLNQQPELHKLASLLGRSKTAKSLPEESVIFESITIVEKAPDTTPEQVNGIGLSDDILRLLPAELALLGINEVEYEFYRKLIEKQLNTYRLQGDSWQERTVLRPVTHHLDEERPRGPFIICIDTSGSMGGFNEQCAKAFGLALMKIALADNRACHVMLFSTEMIHYQLSSSDGLQELVKFLNQTFRGGTDLASCLNEVADKLNTPTWKDADAVVISDFVAQRLPENLINKIKKVQQQQHNRFHAVTLSNYGKPSIMKIFDHIWRFDTGLKSRLLRRWRQ

SEQ ID NO: 7389 - protein, 235 aa, Proteus mirabilis
CLNAWRKGRAQRMENATIETLLPREKLLLHGVESLTDAELLAIFLRTGTYEKSVLELADFLLRKCGSLYHVINADYETLGCFKGIGVGKFTQLQAINEMAQRFIKTKFMHKNILSSSAETKSYLQKRLNWRDREVFVVLFLDNQNQMIDCEEMFKGTVDRVEVHPREIIRQSIKKNAASIILAHNHPSGLSEPSLADKQITEKIFTACQLVGIKVLDHLVVGHDNCVSFAERGWL

SEQ ID NO: 7390 - protein, 143 aa, Proteus mirabilis
YDDATSWTYRRGTDKSMIWVSAQEVIAFHDRILQRFPGVAGMPDPGRAEALIYRVQNRKHYEGITDVFELAATYWVAIARGHIFNDGNKRTAFFVTMTFLYRNGIRIRDTGNMLENLTVEAATGEKTVDQLAKHLQNLVEKTN

SEQ ID NO: 7391 - protein, 228 aa, Proteus mirabilis
FYIAHGGYMFKKSLLAISLLTLSSSIAFAATPTAKLKVSGDIQPPTCTINGETSETTVEYTFAVTPGLFPAKGDLTLEPQSKNIVVTCDAKTYLAFTPTDNRAGTEKKEGDSYFGLGSYKMAVDGKEAVDTKVGYYTVSMKNATVKEDLTSEEKKVYVMDSRYGRSTSKTLVKNDSLGWARSNANDYADGQVFAADFEVTPTINSALKNSDGDAKLDGLATLTFQFGI

SEQ ID NO: 7392 - protein, 77 aa, Proteus mirabilis
SFIASFEAEKSANFCAASRLLVPLIIAVASISQPNPSCGNMMSSGAPCRFNWSAGYSKDMPIGYSPDAAILQGLEPE

SEQ ID NO: 7393 - protein, 470 aa, Proteus mirabilis
EESAVSLSLWQHCLARLQDELPATEFSMWIRPLQAELSDNTLALYAPNRFVLDWVREKYINNINALLVDFCGSDVPSLRFEVGNKPVSARTTESVPKTVTHPAVNSTPTNSQPVRPSWDNQPQSQLPELNYRYNVNPKHKFDNFVEGKSNQLARAAARQVADNPGGAYNPLFLYGGTGLGKTHLLHAVGNSIMERKANAKVVYMHSERFVQDMVKALQNNAIEDFKRYYRSVDALLIDDIQFFANKERSQEEFFHTFNALLEGNQQIILTSDRYPKEINGVEDRLKSRFGWGLTVAIEPPELETRVAILMKKADENQIQLPDEVAFFIAKRLRSNVRELEGALNRVIANANFTGRAITIDFVREALRDLLALQEKLVTIDNIQKTVAEYYKIKVADLLSKRRSRSVARPRQMAMALAKELTNHSLPEIGDAFGGRDHTTVLHACRKIEQLREESHDIKEDFSNLIRTLSS

SEQ ID NO: 7394 - protein, 427 aa, Proteus mirabilis
KGYLFTRRGSGTFVTNTIPDSINSNQWVKTTLPTSSLHIDNELGTLNPNLQKMHAFWQQSQLNTNSRFMFHVGVGCIDLFPHELWGRLLGRVWRHSKKELATFNSPTGYTPLKKMICQYAQSTRGLNCQPEQVIIVNGTQQAINLATRVLLQEEDTAWLDDPGYDSARAIFTSYGIKIHPVRSDSDGMDISQAIDQCPQAKLVFTTPSHQFPLGNTLSLSRRIALLEWASSNNMWIFEDDYNSEFRYHTKPIQALQGLDKHQRVIYAGTFSKMMYPGFRLGFLVVPPSLIDSFKVAKYYTDSHSGFLEQATLALFISQGHYARHVRRIRKACYERYLTLTNTIKKYLSHIFRIEPTDSGIHIVCWLQSGYTEEYIVKEGRKIGLAIQPLSRYCIQSYPKQGILLGYAAHHPSEIEKNIILLAQALSK

SEQ ID NO: 7395 - protein, 331 aa, Proteus mirabilis
RTRAITRYGAIAMKRVLIVKTSSMGDVLHTLPALTDARAAYPEICFDWAVEEGFAQIPSWHPAVDTVIPVAIRRWRKNWFSAPIRAERAQFRHAIQAHHYDAVIDAQGLLKSAFLVTRYAKGSKHGYSRQSAREPLASFFYDIRHNVSKKMHAVERIRQLFALSLNYPLPTTQGDYGIAQHFLSLPAIDKRPYLVFLHATTRDEKHWPEAHWRELIALLADSDLRIKLPWGAEHEHQRAIRLAQGFDYVDVLPKMSLAEVAQVIAGAQSVVSVDTGLSHLTAALDKPNITLFGPTDPGLIGGYGKAQRSLKAAGGDIGEITPQKVFNILKI

SEQ ID NO: 7396 - protein, 187 aa, Proteus mirabilis
YWHLLMHSIPLINTPHYGNLAGKTVNMKNKAIYPGTFDPITYGHIDILTRAAGMFDTVLLAIAASARKNPMFSLEERVALAKEVTQHLPNVEVVGFCELMANFAKKQQATILIRGVRSVSDFEYEWQLANMNRHFAPDLDSVFLLPSQNLSFVSSSLIKDVARHDGDVSTFLPEVVATAMLQKLGKR

SEQ ID NO: 7397 - protein, 89 aa, Proteus mirabilis
SKNFTKTCRYFGHNRETFYSWKRAYERDGEKRINQHKPCPEYLTIIVVKHIEELVIYLRTTYHFGPQRIVYLLLVHNIEILVRTATVYW

SEQ ID NO: 7398 - protein, 200 aa, Proteus mirabilis
FLFYLDKSFRGRKMDLSTYFPLSTYYSYLKRFVLSPTTMGTIAPSSRWLCYEMLNKLNWQQDIQIAELGAGTGVITQQILKRMSSNSVLDVFEIEPAFANELNKINDPRLTIYTASAEKLDSHYNMIISGLPFLSINRRLGLKILKRVHSELLKTQGCFVLFQYTTRYEKTLSRYFHLEKKRVMLNVPPAWVYYCTPKIK

SEQ ID NO: 7399 - protein, 81 aa, Proteus mirabilis
DVHYRRNIMRTYTSTQARANISEVLDIATHGEPVEITRRDGCSAVVISKTEFESYQNAKLDAEFDMMMQRHGHTVEALTNR

SEQ ID NO: 7400 - protein, 375 aa, Proteus mirabilis
SEHYHPSAMKFIIEREQLLKPLQQVSGPLGGRPTLPILGNLLLKVTENTLSLTGTDLEMEMMARVSLSQSHEIGATTVPARKFFDIWRGLPEGAEISVELDGDRLLVRSGRSRFSLSTLPASDFPNLDDWQSEVEFTLPQATLKRLIESTQFSMAHQDVRYYLNGMLFETENTELRTVATDGHRLAVCAMDIGQSLPGHSVIVPRKGVIELMRLLDGSGESLLQLQIGSNNLRAHVGDFIFTSKLVDGRFPDYRRVLPKNPTKTVIAGCDILKQAFSRAAILSNEKFRGVRINLTNGQLKITANNPEQEEAEEIVDVQYQGEEMEIGFNVSYLLDVLNTLKCEEVKLLLTDAVSSVQVENVASAAAAYVVMPMRL

SEQ ID NO: 7401 - protein, 451 aa, Proteus mirabilis
TMRYYQRLIKSLFIINILFHSSQGAATQPNQEQLNKEKVAQLGQQLYHHLQQQQWYQAEKLLVNYQQLPLHETLLVYYAQALLAQKNGNFLQAEFYYQQQLKQQADFIPAQTGLIQLYFSQGEYKKAQYQLNQLSRLSGLSPTINQAIIYYQKQLNDYFKARRFYQISFFYDDNINHAPYLDEQIVSQSTQVIMTRKGAQPIASMGVSHLFSFYQPTFIYANNTLSGYFSARYRDYFAYKQANFTHLYTQLSYQYQKKDYRWTLSPYYEIKSPKKAFEYQSIGVYTGLFFSINKYHSINLSINYYIKKYNKELINLNNHKQLYAISYYYILAENVQLVNQLNYYSSRKKNTLLNYQQYDIKTGVYYLLPKNWQVSLSLQYQIKSFNNYNPLLNKKREDNGFVFTTTIKNKAPIIWGFYPAIELSYTRRLSNVDWLYQYQQHEVLFKLEKQF

SEQ ID NO: 7402 - protein, 239 aa, Proteus mirabilis
EISYNMGKKVFISYKYSDTDVASFKELSMESSEPTKVRDYVTKLQEVIGEEHVNKGEKDDESLEEFKDDTIQGKLADKIFDSTVTIVLISPNMKDTLKAETEQWIPWEISYSLKDKSRKDKSGKIQRSPMNAVLAVILPDKKGNYEYYIKENICSKCGCINLKTNMLFEILSKNMFNIKEPSYSNCSNHDENSVYIGDPSYIISVKWCDFIKNVNYYIERSLAIKDKNENYNIVKKPII

SEQ ID NO: 7403 - protein, 249 aa, Proteus mirabilis
TVLYMTFIKSISTFISLITLFCSFSLHANFEEQDKKLFEDTRKEALNHNALAQYQLAEMYLLGDGVEKNLLNAQLWANEAIKSGYADAYALLADIYLFNADPYFKSYYVEAKELATTAVNKGSMRGKISLATALIAPLSGEVDYQQAMVLLEEATQAHQQELVYAPIWLGILYSGIGNIPVDMEKTNKLFAQANEMTFEGFAQAMASFMFSGQYHIIEPNKQKADAFMKQACEEARKVGNEFYCQPELN

SEQ ID NO: 7404 - protein, 411 aa, Proteus mirabilis
LLSLFVSALGESMSTHSFYQQINQQLEQTRQDGLFKNERIITSSQSADIAVADGSHVINFCANNYLGLANHPQLIAAAKAGMDSHGFGMASVRFICGTQDLHKTLEKNIAEFLGMEDAILYSSCFDANGGLFETLMGSEDAIISDALNHASIIDGVRLCKAKRYRYANNDMVALRAQLEQAKADNARHIMIATDGVFSMDGVIADLKSICDLADEYGALVMVDDSHAVGFVGAQGRGTHEYCDVLDRVDIITGTLGKALGGASGGYTAARKEVVEWLRQRSRPYLFSNSLAPAIVSASIAVLDMLKSGDELRARLWRNAALFREKMTAAGFTLAGADHAIIPVMLGDAKLAQQFAARLLDEGIYVTGFFYPVVPQGQARIRTQMSAAHTPEQIERAIAAFIKIGKQLNVIA

SEQ ID NO: 7405 - protein, 64 aa, Proteus mirabilis
ISRYSDTYIYLINVRIPSNNLTCWFEESNLIAVWHTVKVCLYNKTLILQIDKGFKREILALWEP

SEQ ID NO: 7406 - protein, 66 aa, Proteus mirabilis
RFKYRFLSSFLANPIINPYLCATLALIDTLKREDKGRIVGTSTQGARLYGLRVKAQGSLVDHHADN

SEQ ID NO: 7407 - protein, 60 aa, Proteus mirabilis
LQDFIFIKFIQFVISFITLLDGELTCFFTLKRDFFFVFFINIVLSKNTQLDKIKYKLSEK

SEQ ID NO: 7408 - protein, 304 aa, Proteus mirabilis
DQVHCLIGSVKSFYPYCYYVLIKLGIHLMDETKSTKLLTKRVIVGIDQTTVQHKGSLNQAEQDYIALEVPVALVYNGISHVVMMASPKNLELFAVGFSLSEGIIGSSNEIRSIEIVESCHGGTEVQIELSSRRFMQLKERRRSMAGRTGCGICGTEQLAEIFRPIAPLPFTQTFSLSLLDNALEQLKTVQEIGELTGCTHAAAWLSPEGQLQGGCEDVGRHVALDKLIGLKTQQKWTEGAILVSSRASYEMVQKSAMCGAEILFAVSAATSLAVEVANQYNLTLVGFCRRGRATVFTHPQRLTD

SEQ ID NO: 7409 - protein, 1242 aa, Proteus mirabilis
VKYQSVMLINRGNKMKKQTLNMIVKVIYASCLLGVTHSTLANATDANIVSSLIEQANYWHGKAHDERAIEALQKVLIMENNNQDALYLMAFFTAQQGNEKQASYWREKLARIAPQDPRIAGLKNIRSSQFSEQQLGYARELAQKGQHEEAIKAYQRLFVTHEPPDSLSLEYYQTMAGIPAMLPQAIAGLKQRAQRMPDNKETQKALGLTLTYNEETRREGIAILSKISGDETAKNGLRQALLWLNVRPDDEGLYQSYLQTNPNDKAIAQHYQGAIQGNARQAGYEALNAGNLKQATTYFKQALTVDSQDAQALAGLGYVALRSGDLATGQKLLNQASQSGGEQGQKWKQQAEDAGFYSQLREVQRQAKQGNTQQALDKLSPLTYSSGEKGLSAHLLQADLLRKQGNLPAAYQLLSELYQQHSQNEKVISAYYYLLIQQGKNSQAEQLVAKQPASLRQKLTANTDPSERLRRDAQKALENGHRTQARQLLTQAQRKNPQNNWVYLDLARLMIAEGDKTQAEQLILQLERRQTRDANYIAALFYVEQKQWDKVFTLLNSQPQQNEAEKALLERARFYRQLTQAERYYKTGNLVAMRNTLRPLINQVADYPNDVGELAEKLVNSGAQDEALQLIENDLAKGTKGSVGNYAGHINVFNALGRYAQASSLINDPALQQQTPAAEKQRLAILTNVAQADSLREKGEIKAAYQTLVTSLKVSPDDPDLLMALSRVYLAQSMPEQSNKILSYLEKQQGSDSKLLQAQIEVALAQKDGRKAKTLLQQIPTSSQPAYLLQAAQVAQLNGENRQALALLRSAQWQTTNNTTGTVNTAAGQLMALESENSVMTGSINEDKQMVAVQRSIRQLEQQISPWVQGGIAIRHRNGDKGLSNLTEISAPIAISSVPGEDWRWQFNINPVSITSGTASGERANRFGSGQLQHAERFAKNSDNHDEKNKINADDAGSQRASGVELGLILSDHNTRFDVGTTPLNKDSSTIVGGLTYSPKIGQNGQLTLTAERRAIKDSLLSYMGRTDPITGETWGQVTRNGAKAQYAWDDGKVGAYIGGGYYNYQGKSVESNEEVKVWLGSYANFYKDEQQEVKAGVHVDYMNFKNNQNYFSLGHGGYFSPQDYVAVSLPVAYTRRFEKGEVSLNGAIGVQSYKQKGSDYFPTHAYMQNALNKRHTSDSRIKSRYEEQDETNITYRLGLDAKYYLNKESELGLSLSHDTSGDYAEDNMWLYLKYTPDFLSK

SEQ ID NO: 7410 - protein, 314 aa, Proteus mirabilis
FLCLNQIINNIWRVIMAIDLSNLVTESRNHHSEHIDTLSTLEMLKVINNEDKKVPFAVEATLPHIARLVDKVVTAFSQGGRLIYCGAGTSGRLGILDASECPPTYGTPHDMVIGLIAGGHKAILQAVENAEDNVQLGAEDLRQLNFNAKDVLVGIAASGRTPYVIGALEYARSLGAVTGAISCNPDSPIAQRADIAITPIVGPEVVTGSSRMKAGTAQKLVLNMITTGAMIKMGKVFGNLMVDVEATNAKLIERQIRIVMQATECERATAEQALAQCQRHCKTAILMILAGVNAQQATQLLAQNKGFIRQALAK

SEQ ID NO: 7411 - protein, 435 aa, Proteus mirabilis
AFVQISEFDSMLLRLYQVLLYLIQPLIWLRLLLRSRKAPAYRKRWGERYGFCRGKVAPHGILLHSVSVGETLAAVPLVRALRHHYPDLPITVTTMTPTGSERVRSAFGDDVYHVYLPYDLPGSVNRFLTTVDPKLVIIMETELWPNLISQLYRRKIPLIIANARLSERSAAGYQKLGSFVKTMLRKITLIAAQNQEDGERFIALGLKRSHLHITGSLKFDISVTPELAAKAVALRRQWAAHRPVWIATSTHEGEEAIVLDTHKKLLAQFPQLLLILVPRHPERFAKAEQLTQEAGFKYTLRSSDAIPDAQTQVVIGDTMGELMLLYGIADLAFVGGSLVERGGHNPLEAAAHAIPVLMGPYTFNFKNICAKLDQAEGLITVTDSDSMATAIASLLNDEDYRRYYGHHAVEVLHENQGALLRLLTLLSPYLPPRSH

SEQ ID NO: 7412 - protein, 157 aa, Proteus mirabilis
VMNQHDSDILQLPFESGWQDLTQLLFFQIVSDNDITQAENKLRDIGKDIAQRYPLPDSENIQSLESHINQVLTLFKWGFVTISPAMSELLLVHCAWPHFSANEEEANWRAASASVLEGLYEGWLTHQGGNDKMHVHRQATDAKDAFIFRYANSSSNK

SEQ ID NO: 7413 - protein, 253 aa, Proteus mirabilis
SHCQTKRSQTNFNRSGIADLRCDTCSYLNFTCLVKKTRFITPECIMSDLLNRLKKLAKQANIELTDVQAQKLTAYVAMLDKWNKAYNLTSVRDPQQMLIRHILDSIVVSQYLEGNNFIDVGTGPGLPGIPLAIMRPDHHFVLLDSLGKRVRFMKQVQHELALHNIEPVQYRVEEYQVEKPFDGVISRAFASMKDMLSWCSHLVTEEHGRFYALKGQIHQEELDELSENGLKMPEKVINLAIPELNEQRHLVVF

SEQ ID NO: 7414 - protein, 316 aa, Proteus mirabilis
RGSHMIIVTGGAGFIGSNIVKALNDEGYTDILVVDNLKDGTKFVNLVDLNIADYMDKEDFIASIVAGDDFGDIDAVFHEGACSSTTEWDGKYMMDNNYQYSKELLHYCLDRQIPFLYASSAATYGGRTDHFIEERKYEAPLNVYGYSKFLFDEYVRQILPEAQSMVCGFRYFNVYGPREGHKGSMASVAFHLNTQVNDGQNPKLFEGSETFQRDFIYVGDVAAVNLWFWRNNVSGIYNCGTGRAESFQAVADAVIAYHNDKELSVEHIEFPEKLKGRYQAFTQADLTNLRKAGYSAPFKTVAEGVALYMQWLNQDK

SEQ ID NO: 7415 - protein, 573 aa, Proteus mirabilis
AFSQLRYSSLVFINKLLITMLGRDMKKLSGRIYLALVLIASLFIVFEKASLIYTALLSVSVYFIIFTLCFVLSSRALFSAITTGTLFIIIKFINQLKVHYYKESLLFSDFNLAFDSSNLGTLTQYWEAGVAIIAMAIWLIINMVTAWRFSRKSPIATRLSSLLLIIIGLTTIHFTVNKWQSEWEGTLPSGRGTVTNLIMSGYQTAYHPPYYAQSADYFIEQANRVVLPETQTEVKPDIVVLLQESTVNPSIYQFDKNVDLPDLFMFKKDEGVSAQSPLRVQTFGGGTWLSEFSVLTGLNTDDFGARKNSVFYFVVDKLNESLFRQLKSQGYYTVLLTPFNRNAYHAGYAYEKLGVDEIIQPQELGYPGSLEENLWTIPTQDMINYLKEILKTHTDKPLFIFSLTMYEHGPYKGSHSDDYQLAGQTESPDAPGKFSHYMEKIIASDPAIEDFSHFVANRERPTLFLYFGDHQPNIDLKNYQSPFSDPAHITQFTLRDNLTQGATLSTGELTDINFLGGMLLERARLPLSPYYKANIQMRHLCQGKLNDCEDEKLVNSYKNYIYDKLNVAGGKDN

SEQ ID NO: 7416 - protein, 290 aa, Proteus mirabilis
DVLHSPHSPLIMISHSRSKHMNKSVEAVILDWAGTVVDFGSFAPTQIFVDAFAQAFNFKISLSEARGPMGMGKIDHIRALLNEPNIRTRWTAQFGHPPSEEEAQHIYRTFMPLQIAQVVHFAKPIEGALEAISTIRAQGIKIGSCSGYPKAVMDVLVPKAAEYGYQPDCVVASDEIAAGSRPGPWMALKNVIELGVMSVAHCVKVDDAVTGIAEGLNAGMWTVGLSVSGNEFGATFEQYQTMEQAEIENRKRIAENKLRTAGAHYIIDTLANLPAVIEDINQRIANNQKP

SEQ ID NO: 7417 - protein, 437 aa, Proteus mirabilis
MASLDVYMNEYYVGIFTKKSSGAHSFQYTEDWVNQPGSRPISLSMPLQLQEYQGDCVYNFFDNLLPDNTEIRNRIVSRYNANSNQPFDLLAAIGADTVGALRLLPSGSTPADIKKIEYQKLNDIELEKILLGYKSNTPLGMLKEYTDFRISIAGAQEKTALLLKDNHWCVPHNNTPTTHIIKLPIGVIESHSYTMDLSNSVENEYLCTLIAKEFDLPVPHCSIIKTKNVKALAVERFDRKYSSDKSWIIRLPQEDFCQILNIPSALKYENEGGPGIIDIMKYLLGSSNADQDRFHFMKAQVLFWLLAATDGHAKNFSVFINQEGRFHLTPLYDIMSIYPNFGGRGLNPRDAKLAMGLKASRGKKYAIEQIFPRHFYQTAEAVGFDPSLMSDILRYFYQEMDDVIQRVKQQLPEDFPSEISNTILDGMKARAVRLANI

SEQ ID NO: 7418 - protein, 160 aa, Proteus mirabilis
PLGLNWNLKACRRFILPIILWSMKNETNIRRGRHCVFLMHVHLVFVTKYRRKIFDQDAIEKLRGYFASVCADFDVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 7419 - protein, 64 aa, Proteus mirabilis
VCMQGTIKNLIKSLLLIKQVINHYLNHTINFYTHHIDVTRIFLSYYIILILFSACTKTGSFLFY

SEQ ID NO: 7420 - protein, 240 aa, Proteus mirabilis
YRKQIMVKVTIIMQLSEQRSASQKNLSYIVAEKLGKQILSGYYEPESLLPGEIELAELLSVSRTVIREAIKMLAGKGMLLPRPRIGTRVTPMQNWNLLDNDLLNWWIDSGEFNKVSHYFHHVRLAIEPQACYLAALHASETQKESLLFLATEMQLLKDNFNRQHWLDIDTQFHYLIYQASGNPFFASFGSLFLSAYKKYFDLIVGNETVQPETHNQIVQAIIEGDGNRARDLCLILLIND

SEQ ID NO: 7421 - protein, 370 aa, Proteus mirabilis
GYFNMKILVTGADGFIGKNLCVRLEENNFELIKIDRDSSKHDLELGLINANFIFHLAGVNRPKNEYEFHEGNASLTEEITHFLIKNKKKTPIMLSSSIQANNDNKYGESKKLAENHIEAYGLKTDASYYIYRLPNVFGKWCRPNYNSFIATFCHNIANNIDIIINSPTAKVSLIYIDDLCNELISLLNGNNKVGFQNISPVYETTVGEVADLLYTFKNSRNTLVTEKVGVGFTRALYSTWLSYLNPQQFAYSVPHYGDQRGIFCEMLKTQNSGQFSFFTAHPGITRGGHYHHTKTEKFLVIKGKALFKFENIITGEKYELTVSDNEYKIVETVPGWSHDITNIADSELVVMLWANEIFNKELPDTIARPL

SEQ ID NO: 7422 - protein, 99 aa, Proteus mirabilis
VFFNMKIILRTFIFLYFIFLLILINILSISDYEWMIGEGDIDNLCQLPLNGRYVIEPILILIPCILLLFLEKNKKLRWGYVTITVMYIIWSFYLRFNFF

SEQ ID NO: 7423 - protein, 67 aa, Proteus mirabilis
INFKCIKKIRIKYFNLNKIVIKCYLNQNKIINKLLSLFEYLNTSLIIMNEKTYNKKCKIIVKYLTLY

SEQ ID NO: 7424 - protein, 345 aa, Proteus mirabilis
RKLLVINFNGKTLLITGGTGSFGNAVLNRFLETDIKEVRIFSRDEKKQDDMRKKYNNHKLKFYIGDVRDYSSILNATRGVDFIFHAAALKQVPSCEFHPIQAVKTNILGTENVLEAAIANSVKRVVCLSTDKAVYPINAMGISKAMMEKVMVAKSRNLDSNKTVICGTRYGNVMASRGSVIPLFVDLMREGKAITITDPNMTRFMMTLEDAVDLVLYAFQNGNNGDIFVQKAPAATIETLAIALKELLNAPEHPINIIGTRHGEKLYEALLSREEMLAAIDMGDYYRVPPDLRDLNYDKYVEQGDSRISEIEDYNSHNTTRLDVDEMKKLLLKLPLIQKLHTNKI

SEQ ID NO: 7425 - protein, 395 aa, Proteus mirabilis
VNIKGLCMKITISGTGYVGLSNGILLSQHNKVVALDINKEKVELLNKKISPISDKEIEEFLATKELDFTATLDKEFAYKDAEFVIIATPTDYDPKTNYFNTSSVESVIRDVLEYNPNTTMIIKSTIPVGFTKQMREKYHTDNIIFSPEFLREGRALYDNLYPSRIVIGEQSARAEKFADLLQQGALKKDIDVLFTDSTEAEAIKLFANTYLALRVAYFNELDSYAQAYGLNARQIIEGVCLDPRIGNHYNNPSFGYGGYCLPKDTKQLLANYESVPNNIIGAIVEANRTRKDFIADSIIAKSPKIVGVYRLIMKSGSDNFRSSSIQGIMKRIKAKGIEVVIYEPEMKEETFFNSKLIHDLDKFKAMSDVIITNRMASALNDVEEKVYTRDLFGND

SEQ ID NO: 7426 - protein, 372 aa, Proteus mirabilis
TDINFVNQRHILFIIDGLPGGGAENVTLRLANGFHQQGYQVTLLSLHNKLAYELPDFIDYIVDHDEYRGIFRKLTEISRRAKSLDKVLTRLFAQKGRPALVLSNLHKTDRIVCRAKQLRHCNVWYCIHGIYSQSYLGNKSGFSYWLKKKKIQRVYKDKNLVCVSNAVKDDLIHAIGVDAQQLKTIYNPFNIMEIQHKASQPNPFAGKAYILHVGRFHEVKRQDRLINAFAKANIPCQLILLGEGTPVIKQQLQQQIAQLNLNEKVILAGFIANPLPIIQGAKVVALSSDSEGLPTVLIEALICGTPIVSTRCPGGVSEIMTDELTNYLSDMDADSLADKLRLAYYAPPQILPSSYAKFEINHILKQYIALIP

SEQ ID NO: 7427 - protein, 467 aa, Proteus mirabilis
LGINMTHDTRSLYSQLSSIDSLLHQVDIQTLVDGYGQTFIVEHLRKLQEEARIIIRQNNQLPQWHDNWAEELKNRIALQRKAAIKPVFNLTGTVLHTNLGRALMAESAIEAVSQVMRSPATLEYSLDGASRGHRDRAIADLLCELTGAEDACIVNNNAAAVLLMLATVAPDKEVVVSRGELVEIGGAFRIPDVMCQAGCRLKEVGTTNRTHLKDYRNAINENTGLLMKVHTSNYSIQGFTAEVEGAQLAALGKEMNLPTAIDLGSGSMTNLAALGLPSEPMPQDYLQQGIDLVTFSGDKLLGGPQAGIILGKKAWIEAIQHHPLKRALRVDKMTLAALDATLRLYQQPEKMIKDIPTLRLLTRTQTEIHDMAQRLLPHFQAYYGDNYHITISSCASQIGSGSLPIESLPSAALTFAAKDGKGSQLDALAAHWRNLEKPIIGRITDGRLWLDLRCLEDENALIQALSL

SEQ ID NO: 7428 - protein, 629 aa, Proteus mirabilis
KCINTGSITMIFATAGHVDHGKTTLIQAITGVDTTHLPEEKKRGMTIDLGYAYWPQTDGSVIGFVDVPGHEKFLSNMLAGIGGISHALLIVACDDGVMAQTIEHTAILRLAGCPNITVILTKADRVEPPRIDEVKQQITTHLLNLGWSAPQIFVTSASTGAGIAPLRDYLVTLHQQEQQHPQWHKRFRLAIDRVFSIKGAGLVVTGTALAGQIALGDTFWLTGADKPVRIRALHAQNQPVEQAGAGMRIAINISGDVSKETVSRGDWLLSQAPLYPSHKILVSLIADEPIKHWQPVHIHHGTRHITGRIALLNNTDETPLLAELILDEPLWLVDNDRLILRDISAQRTLAAAKVLCLHSPRRGKRQAEFLSWLSALDKANTVSDNLALYLPKGELLLTQFAWAQQLTETALDTLLTTFDVISISGVVISKANAEQAKAKLLRTLEEYHQQHNDQVGVGRSRLKRMALPTYHDELVYHLIDQLRQEGAIKQTRGWLHLPTHGLAFSAEQEALWQIAKNYFQQSEPWWVRDLAHEMKNDEKVIRSLLRKAAQLGLIIPIIADRYYTHDSIEKFAAIIVKYNETNGSVTAADFRDELAVGRKLAVQILEYFDRTGFTRRKKDLHILRDKGLF

SEQ ID NO: 7429 - protein, 703 aa, Proteus mirabilis
AEIKKKEINSDCADFLEIYPKSDITYHPNNNSIDITINDDYFDQSAYGNELTYGGLGVFNNYRIYGMKLNGSNNRNFYQGDFKTGINFYNWILRNNSSFSSGDGKTYYRFNETTLSRTIERIKAILQLGQITSNSELLDSADVNGFQLYSDSSYQNSKLTVPITGMSEKPATVEVTQNNRLLYRTIIPAGPFQLNNISGVSSSQPLHVKVIQDDGTIQEFDVITSNKDLKNPQSSTSFNFFMGKYRKNSSDERIHTPFITGFEGGINYLNHNFLGGMEISSKYKSIVGSVNSVFGEHRPLSTGFGIKYASSSNKGDGFQANANLSLPVSVFSLGLSTIYRSRNYSTLYESLQIDNIEDPLDDNLANNQTKTSSSLSLSLGNQRYGSLSYSLSYSQYYGDKKDNYSNTISYGKRFPFMSFNISYQKSSNFEDRTFVNINVPINNSSSFSTQYQHYKTSSLTTNYSNYHNDLFRYSIGATADKDSKDKNISGNINATTAYSQISATGSFSNSNQKSAMLTASGAIAYSDGLFATSPVELGDTFGILRVPGQSGILVNSMGGGTTITNHFGTAVIPNLPVNKKTTVLLNTKNLPLNVMLGTTSFDIALAKGTVFSREIPVNTMKQVLLEIKKPDGKPVNTANSVIDDKGNLIGVIMGDGNVIISNEQIGKPLKVKSDNGDICSVDYSVPEEFNPDFLYEKVDAICK

SEQ ID NO: 7430 - protein, 276 aa, Proteus mirabilis
YKDKIGVLFMLALSVRQPLNIYYWLIAISLVYISLLSWVLNSWSMTESAHHIDQQQQNTLSVYQVMFSPPKQSTTMIEPRIKIESQQPPIALPRSENGEFIEAPKQPAKKRQQQPAPITPKAIKQVKKQPVVDKTVPIKLPDLTNHNIVQSTSQPSAENLTQHTASSLAGSSRALSENGIGQGESENHYISLLRREIERHKRYPAQARRMQDEGLVVVRFSLTDEGYISSVVLEQTSGVASLDNAALAAVKRVKPIGPKPNNLSDPLTISLKFQLN

SEQ ID NO: 7431 - protein, 364 aa, Proteus mirabilis
KSGNSIGFISRAPLSLFHYFLQCFSQSTNKLCNCSLWLFRSKRRLTHKNVTRSIAMTTTQSTDYNIIVMSDPQPWRLDLDNNDPNNDQSRWETTVKSVRDSIQALHREKSFAFGIINGDLTEFGRRSQRESFRALFAPSPLGFNTYVGLGNHDYQNNVGDCAEPSNADYSMNACARGMVFDMHYRIEEYRNYATSGNFRYDSSEYSGSKAYSWEYGDIHFVQLQNYPTYHVVLDHWSASTINVTDSIDWLEKDLIQARNSNKTIILNFHDGNQHFPEKSSQEELTFFKYMLEHYGVKAVFVGHTHYVGQDNRYGGSEIFGDVPVYNSGALFKGDYLAVEIRGTELSITVYNGLSGTPQLIEKWN

SEQ ID NO: 7432 - protein, 383 aa, Proteus mirabilis
ECGKCSRSLCCYADALVITINMILSRLLIRHFRNIEQADLPLADGFNFLVGPNGSGKTSILEAIYTLGHGRAFRSAQANRVIQHDENAFILHGRLSGLDEESRGYSIGLSKDREGNSTVRIDGSDGHKIAELAKLLPMQLITPEGFTLLNGGPKYRRAFIDWGCFHNEPRFFVAWSDLKRVLKQRNAALRQASSYRQLLPWDKELILLTEQISQWRAEYTEDIAKDIEETCQLFLPEFTLKVSFQRGWDKETDYAQLLERQFERDKVLSYTSLGAHKADLRIRANGTPVEDMLSRGQLKLLMCALRLAQGEYFTRKNGQRCLYLLDDFASELDANRRQLLAERLKSTQAQVFVSAITSGQVKDMLDVNSRLFSVEHGKIEVKP

SEQ ID NO: 7433 - protein, 239 aa, Proteus mirabilis
SALKRYICIELRYIYTSTGGCMFKKSLLAVSLLALTSSVAFAATPTAKLKVIGTIQAPTCTVNGETSETTVEYKFDVSPGLFPAKGNLTLEPISHNITVTCDARTYLAFVPTDDRAGSELEANAANFGLGTHHETNKEGEAVDTKVGFYGITMKNATVKPTADAEEAKVSVFYNGAVNSSQSLQKEKVFAWAKSSSDFSAGEVFAADFEIKPTINSELKNSGGEPKLDGLATLAFQFGI

SEQ ID NO: 7434 - protein, 156 aa, Proteus mirabilis
IMLNKEENLEKESKTTPLNVESKAVQTHLGFLQDIISRLSDKSSTCKNWCITLTSAFILLSLRLENGSKYILLSYIPTLLFALLNTYYVYLEKSIRNQYNTFVSKLHNNQLTTSDIYTIKVNFEEKCNCKQWKLSIKSFSILIFYLPLWIINVVIT

SEQ ID NO: 7435 - protein, 418 aa, Proteus mirabilis
LVVKLWTFIYAIRHFIMTTLHDKNIILGISGGIAAYKAPELVRRLRDKGAIVRVVMTPAAHAFVTPLSLQAVSGFPVADDLLDPAAEAAMGHIELGKWADLILLAPATADLIARLRMGMANDLLTTLCLASAAPIAIAPAMNQQMYRATITQENLTALAQRGCLIWGPDSGSQACGDVGPGRMLDPLELVALAEQQFAIQHDFKGKKITITAGPTREALDPVRFISNHSSGKMGFAIAQAAAQRGAEVTLIAGPVTLPTPACVKRIDVESAQEMYQQVMDIAQSQDIFIGCAAVADYRAKQVAPEKIKKQGDEVTITMIKNPDIVASVGKMVEHRPFVVGFAAETQNVEEYARRKREQKQLDLICANDVSLKDAGFNSDNNALHLIWANGETRLPHSSKTQLSHRLLDEIAKHYDEKN

SEQ ID NO: 7436 - protein, 222 aa, Proteus mirabilis
GGAKMMKKKGDKILRHTASERINHWVVVIVFLFTAISGLGFFFPSLNWFMNILGTPQLSRLLHPFVGSAMAILFIFMFFRYLKYNFIDKDDLVWAKNIHKVLKNEEAGDIGHYNLGQKGIYWALSISLILLTVSGIIIWRPYFAEYFSIPVIRIALLVHSFAAILLIITVIVHAYAAFWVKGSIRSMVEGWVTRGWAKKHHPRWYREVLEEEKKEAEKQSQK

SEQ ID NO: 7437 - protein, 414 aa, Proteus mirabilis
LRKKSCLERILMRLALIIDDYLPHSTRVGAKMFHELALELQSLGHNITVITPAENQQYSLYVDNLDGITVWRFKNGPIKNVKRISRAINETLLSYNAWKAIKHLVNKDSFDGIIYYSPSIFWGKLVNNLKKKCQCPSYLILRDLFPQWVVDAGMLKSGSLIEKYFRFFEQYSYKQASIIGLMSKKNLDFFYTHKNNKYYKCEILRNWANTSEISIKKEGYTSIRTSLNLQNKTIFFYGGNIGHAQDMENLMRLVKKMSIYPDAHFLFIGQGDEVDLINSLANKWNLSNFSYLPSVNQNEFKLILKEIDIGLFSLAAHHSAHNFPGKLLGYMANHIPILGSVNVGNDLLDLINHENAGFVHINGEDDDLFESAKKLYLDITLRKKCGHDAYKLLCKEFAVTSIASTLIDRLRLLK

SEQ ID NO: 7438 - protein, 385 aa, Proteus mirabilis
CSKKVLKLMNAPLRLAIVRQKYRPDGGAERFIARALDALSSDALELNVITRQWQGDTHPDWHIHLCNPKKYGRISRESGFAKAARACWQENHFDIVQSHERIAGCDIFRAGDGVHRRWLLQRQKILPRWKGRWLFYDRYHRYVMNAEQQMYADPALKQVICNSQMVKKEIIADFGLSADKISVIYNAIDHNVFVPATNSQKQRLKTQYNIPQDKPCFIYVGSGFERKGLAAAISAIANTSSILLVVGSDKNQRKYEQLATQLGCRQRIFFLGMQKKTLDFYQIADALLLPTLYDPFPNVILEALSCGLPVITSTSCGGAEFIQNGKNGFVCDALDIPALTEAIVQIPTNSAWSEMSQVARETILPYTPKRLSDELISLYKRILTL

SEQ ID NO: 7439 - protein, 331 aa, Proteus mirabilis
KMEKSFIQTQQQISFVKSYFSRLLEKELGLIEVQGPILSRLGDGTQDNLSGHEKAVQVKVKSLPDSTFEVVHSLAKWKRKTLGRFGFSSGQGLYTHMKALRPDEDRLTPIHSVYVDQWDWEKVMEGEERTLPYLKQTVGKIYQAIKETEKAVSDEFGLTPFLPDQIQFIHTEELLRRYPDLDAKGREKAIAKEYGAVFLIGIGGKLSSGEAHDVRAPDYDDWTTPNEDGFAGLNGDILVWNPVLQDAFEVSSMSIRVDPETLMRQLTLTDDTQRLELDWHKALMHGDMPQTIGGGIGQSRLVMLLLQKEHIGQVQCGVWQQDTRLAFADML

SEQ ID NO: 7440 - protein, 325 aa, Proteus mirabilis
PFMNPLTTLRVASVQLQHKANDKDYNLAKIHQFIEMAASEKVNLLVFPEMCITGYWHVPKLPAQQVYALSEKLADSASLKSIKQKAQQYAMAIGVGLIERDNNNNLYNTWVVCMPDGSLQKHRKLHAFEHPVICSGDQYTVFDTPWGIKMGILICWDNNLVENARATALLGADILLAPHQTGGTHSRSPHSMKPIPMALWENRQQDPQALQAAFQGEHGKGWLMRWLPARAHDNGMFIIFSNGVGRDEEEVRTGNAMVIDPYGRIVKESCAIEDDMVVTDIDLTLLPESTGRRWLTGRRPELYQILTTRQGNEQDPISVRFGNKD

SEQ ID NO: 7441 - protein, 214 aa, Proteus mirabilis
VIMNIIKSFYFTLPFLSISLVSTSAFADIYNDLAPSFNDDCFVSQKDITIEYHNLKAYMFKSNENNKLDDRYTLINISCPSPVSPVLFSIKADEKMGTTTDNAQTHFGLGTINTTGKIGFFQVSIEKATVDGIDVNIYETDNENNIGIIKTSPQLKIGTLNGFSQDGVTPSKGNNYQLKLKISPTIYSLKETNGPLVDGGELSGSLLFDFSFGS

SEQ ID NO: 7442 - protein, 784 aa, Proteus mirabilis
LGMKKKLTSILSLTVIAMASIHFCYATTGMLELDGEVLPEPTSYTHPPLQPTVSTQLFDDVALSEARNIEEQLTLAQMGSPSPIVLSGRRLLSGVTFRMANDLFIDSATLTMKVKASSGLVQADQTLHLMLNGQPMGFLPLEEGEQEHEYMLEIPEMMLTNVNNLSFRLASRDALDEKQCIPPLADELSLVISPDSSLNYRGRWINGGYSLERLPLPFFDPDRMTATSLPIVLADKPDNGQVTAAAIAASWFGSFSHDIKQIDLPVLMNQLPDSDGVLIGYAGQTIAGITLPSGKNGQLTIVDNPVDPVFKLLLISGDDEKTLRQAAWALNSGKLPPNDQLTVAAQHIPVRQDYDAPRWLNTNHSVTLGEIAHGRDDFTRQGINHAPNQFSFRVSPDLFWWDGDALPLDLQYVFPHSDKINSRRSSLIASLNHQFIGALYPSRSEPLGILRQWLGMENAQQSSTLYLDPRQIYSQNQLEFYFDLHEYDDAPCILTDGQGLISRIDPQSTLQFKNTWHYSRMPNLAYFSGASFPFSRRADFSQTTLLLPENPTTEELYTLVNLMARSGYSTGTPVSYISVFLGAQALEKNQLAQKDILAIGELGSNGFLPSAFSQKTFSFINNQLEIQSPSLIDKAKSWLAGDPLSPSSDAANYLAPLNDWRGMMSFISPWAKDRVVVLVTAKGNDSIKNIIGDLNHANVNAAIKGDLTLISGQDTVMSFHLGEHFSQGDLPLLQQFLWYCTRHVYLLGMLAVGFCALTGSVVYCWLQRRSTRRLSEISKRHVDK

SEQ ID NO: 7443 - protein, 485 aa, Proteus mirabilis
AIKKSAFIIKACDKNSHSYVEFHTCLRYNHYLLFIKSIENTSMSQTNQVPKIGFVSLGCPKNLVDSERILTELRTEGYQVVPTYDDADLVIVNTCGFIDSAVQESLEAIGEALDENGKVIVTGCLGAKENQIREVHPKVLEITGPHSYEQVLSHIHHYVPKPSHNPFTSLVPEQGVKLTPCHYAYLKISEGCNHRCTFCIIPSMRGDLDSRPIGEVLNEAKRLVNAGVKELLVISQDTSAYGVDTKHQTGFWDGMPVKTSMVSLCEQLAKLGIWVRLHYVYPYPHVDEVIPLMAEGKILPYLDIPLQHASPKVLKLMKRPGSVERTLERVKRWREICPELTLRSTFIVGFPGETEEDFQMLLDFLTEARLDRVGCFKYSPVEGAKANELPDPVPEEVKEERYHRFMQLQQQISTERLQEKIGKVLPVIIDEVDEEGAIGRSMADAPEIDGAVYLNEQFDVEPGQIVRVLIEHADEYDLWGTIVEQ

SEQ ID NO: 7444 - protein, 337 aa, Proteus mirabilis
TPRKSSQPSSLAWEVVLHLLGTLQRNIALTLSLMLLSFLFSAPAFSAKLAIVIDDFGYRKKEDNQILQLPTAVSIAILPNSPHGKEMATKAHAQGREILIHMPMAPISKQPLEKDTLKPSMDQAEINRIIQNAINRVPYAVGMNNHMGSAMTSDRQAMDRVIKALNHSDLYFLDSVTIGNTQAATAAKAAGVPSLRRHVFLDNVQTEAETRQQLNRAINLARKNGFAIAIGHPHPSTVRALQQQLPLLPADIQLVAPSGLLTPSPDSPVVQEPPAVIPPTEQSKEPKPATWLKPAQQAIISMKKSTLMKVLTKKLMTFEQDKQFPSQHLESNKDKVE

SEQ ID NO: 7445 - protein, 158 aa, Proteus mirabilis
FARFCHLTLYSKDSLIHYSVIPFTIASLENTNVMSVSLYSGKVALKLLFLQFMTFVILSAGFYFKSTDWSFSAFLGGIACWLPNIAFLLLLRLQKVDENEASVRINWLFAFSEGLKVILSIALLIVALGVFKAAFAPLVMTYLAVLVMQVVAPAVING

SEQ ID NO: 7446 - protein, 142 aa, Proteus mirabilis
REVDMADTSFHLKVVSAEKHLYDGEVKHIQVTGSEGELGIYPQHTPLLTAIKPGMVRVVKTSGEEEFIYLSGGILEVQPTGVIVLADTAIRGRDLDEAKALESKRKAEEHIQSSHGDVDYAQASAELAKAIAKLRVIELTRR

SEQ ID NO: 7447 - protein, 72 aa, Proteus mirabilis
RQIETIIEVFSPHEKKSNIIYMPHKPYGGGFLMDISNAKSELGYEPKYDCKKLFEAYKVEMNIKRFDQLRVK

SEQ ID NO: 7448 - protein, 275 aa, Proteus mirabilis
LVPELPEVETSRRGIEPHLVGNILHYAIVRNSKLRWPVSEKIKTLLDEPILNVKRRAKYLLIELNQGWIIVHLGMSGSVRILPEEQPEEKHDHIDLVFRDGKVLRYTDPRRFGAWLWCEDLATSSVLAHLGPEPLSAQFNAQYLYQQSKNKKIAIKPWLMDNKLVVGVGNIYANEALFSSGIMPDRKANSLTEQECDVLVNAIKAVLTRSIEQGGTTLKDFLQSDGKPGYFAQELFVYGRKDKACLICGHTIESIKQGQRSTFFCRHCQHGEITD

SEQ ID NO: 7449 - protein, 291 aa, Proteus mirabilis
GEAEMAGAKEIRSKIASVQNTQKITKAMEMVAASKMRKTQERMAASRPYAETMRSVIGHLALGNLEYKHPYLEEREVKRVGYLVVSTDRGLCGGLNINLFKKLLADMKEWSDKGVEVDLALVGSKAVSFFASVGGNVVGQVTGMGDDPQLSDLIGPVNIMLQAYDEGRLDKLYVVANKFINTMAQEPKILQVLPLPPGDDEELKEKSWDYLYEPDPKTLLDTLLRRYIESQVYQSVVENLASEQAARMVAMKAATDNGGNLIKELQLVYNKARQASITQELTEIVSGAAAV

SEQ ID NO: 7450 - protein, 85 aa, Proteus mirabilis
NKLETVMENLSMDLLYMAAAIMMGLAAIGAAIGIGILGGKFLEGAARQPDLIPLLRTQFFIVMGLVDAIPMIAVGLGLYVMFAVA

SEQ ID NO: 7451 - protein, 326 aa, Proteus mirabilis
LFEEYIMMKAVIPVAGLGTRMLPATKSIPKEMLPIVDRPLIQYIVEECAQAGVEEIILVTHSSKNSIADHFDTSFELENMLEQRIKNKLLKEVRSICPENVKIIQIRQGQALGLGHAICCAHPVIGDNPFIVLLPDVLLNSHYCDPCHDNLSAMIKRFQKTERSQIMVEPVALTQVHQYGIVDCQGVFCPQGNWAPIRRIVEKPNPEQAPSNLSVVGRYVFSAEIWPLLDGLPAGVGGEIQLTDAIDLLLRKEVAEAYTLVGKSHDCGNKLGYMKAFVEYGLHNSELKEEFALWIQELYAKDVLSQTMANNRPTLKEVDNSVMTIF

SEQ ID NO: 7452 - protein, 197 aa, Proteus mirabilis
YKEDSLIMKILKGMIFLILLISHFSHASFQLETMTVILDSEEPRKIFNVKNTGSEPILLSTKVSDLDKQHEIAKNIIITPPITRIEPDQSQNINFILKDGIEFDDEQILKASFQGIGVAKVNSTKMPIRQDIAMLIIPKGLTIEREPWKNLEVKQVNNQLILKNNGKQVIRMAPAFSSLPSNNGYSIGQFLYFVLTK

SEQ ID NO: 7453 - protein, 325 aa, Proteus mirabilis
VDGECMKKPAFIITLDTEGDNLWENEHNITTQNTHFLPRFQQLCERFQFKPVWLTNYEMAIDEAYIEFAQDVIARNTGEIGMHLHAWNSPPLVALTDNDLHYQPYLIEYPKSQMRDKIAFMTDLLENKLQTKMLSHRAGRWAFNETYAQLLIEFGYQVDCSVTPKVDWRFTKGDPAQSGGTNYSNFPSHAYFMDVNDISKAGGSTLLEVPMSIQYKHSPFMNKIKQGYDKLRGKQRSPSVNWLRPKGGNAQQMIEVAQKSLAQGHSHIEFMLHSSEFMPGGSPTFRTEQDIDGLYNDLETLFNFLQDKVQGMTLAEYYHNKVQAK

SEQ ID NO: 7454 - protein, 158 aa, Proteus mirabilis
KQGDFMDNIYQIDNLDRDILHALMANARTPYAELAKKFAVSPGTIHVRVEKMKQAGIITGTRVDISEKQLGFDVCCFIGIILKSAKDYHTALDKLDKLDEVVEVYYTTGQYSIFIKVMCKSIEALQDVLINKIQTIDEIQSTETLISLQNPITRTIKP

SEQ ID NO: 7455 - protein, 437 aa, Proteus mirabilis
QHLLYIINMNYKHIPFTNILLYIFILLSSFSYIKLLPNNMDTQPWYIVISIFICLIFILKNKIIYRENLIFVYLLFSYFIVLTIDILNQKYFLLSDLIRNTATYISLFTVSFSFIYCLKKKILTSKLILAFIVIWFIGGTIQFFINSNFFSFILDSRTSPGRGVTGFSPEPTFYAIIITLLYFLFYITKTTLEGNISFSFIFNKVLFLVLLQVFIFSKSSMMMLFWLIVFLFSYIVYTAIAFKEKKIAQLIILFIGIFILLILIYSIILISNTDYINSIKGYRFYKIFQISNNGLSSLIYQDASINDRVAHLVIPWYGLMKNYLFPGGFYSFTHYLDNKGLIFEGIFWYGSLTNKIMSYIGSVIYELGFLSFPYLFYILINLIKFISQSKNKKGDIILSCSFFTLIFLSIPLSNPIVTGFITTIAYINYHNFHMRNN

SEQ ID NO: 7456 - protein, 313 aa, Proteus mirabilis
IMSLQSQDIIRRSATNSLTPAPQVRDYKEEVAKLIDVTTCIGCKACQVACSEWNDIRDKIGTNVGVYDNPTDLTAKSWTVMRFSEVEENGKLEWLIRKDGCMHCADPGCLKACPAEGAIIQYANGIVDFQSEHCIGCGYCIAGCPFNVPRINEEDNRAYKCTLCVDRVEVGQEPACVKTCPTGAIHFGSKESMINLANERVTELQTRGYDNAGLYDPQGVGGTHVMYVLHHADKPNLYHGLPENPEISSTVKFWKGIWKPLAAVGFAATFAGAIFHYLGVGPNRTTEEDEEAAQKEMEASSKTQTSVNKEEQK

SEQ ID NO: 7457 - protein, 85 aa, Proteus mirabilis
LDFWRIDMSRVCQVTGKRPVSGNNRSHALNATKRRFLPNLHSHRFWVESEKRFVTLRVSAKGMRVIDKKGIESVLADLRARGEKY

SEQ ID NO: 7458 - protein, 349 aa, Proteus mirabilis
CIVWKVNVSFKLNKKCMDPKNILVIAIARFGDTLLITPVIHALKERWPNARIHVLAHKRSACILQHNPDIFSVKPFSKKRARWRGWLPHKPYDLALVYGNDHSLVQYARRQSQHVVAFAENNQKQSDITWVAYPKELMVAQKERALLINALGIYPTNWQLRYSISSEEKQFAQQFIESNALINKHIIGLQLQSFPAKAYRDWPIEHFLQLAKQIMTHDEQAYFLLLGGKESQQVAIELAKKIGTEHCLALAGQVSMRENAAIMAHLSLYIGVDTGPTHLAGALGIPMVAMYHSYHPGCYLAPLQHSCCHIIQHPIALADASREDSMSDISVANVWHAVSDILNGIKVKQ

SEQ ID NO: 7459 - protein, 361 aa, Proteus mirabilis
SVVCRPSSFSGRQKKEKETMSIRQLSRLTHRLGILLTLSVMLMISPMTQATETQAGWQQFKARYITPEGRVIDSANQNISHSEGQGYGMLMAVMSDDRQTFAQLWHWTAMSLYRGDLGLFKWRYEPENNQHTPDPNNATDGDILIAWALLKAGEKWHDESYLSASDSIQHAILEHTLVKTENYSVLLPGINGFKTPEEIIINPSYFIFPAWKDFYRVSHDSRWKNLINDSQSLLRKMRFGKYKLPSDWVSLYPDGHLAPSEKWPARFSFDAIRIPLYLAWAQDKLALQPFVNYWQQFDRDKTPAWISIDGKERADYNLTPGMMAVRDLTMKTVIENVDLTKDTDYYSSALHLLAAFAQNNN

SEQ ID NO: 7460 - protein, 212 aa, Proteus mirabilis
FVLLLAGALSVMAEEKETKKKRRNRRDEILQSLAQMLESSDGSQRITTAKLAATVGVSEAALYRHFPSKTKMFDSLIEFIEDSLVSRINLILKDEKETIARIRLILILILGFAEKNPGLSRILTGHALMFEQDRLQGRINQLYERIEVQLRQVIKERKIREGSAFLHDEALLASQLLAFCEGMLARFVRTEFRYHPTQEFEARWPLIQAQLQ

SEQ ID NO: 7461 - protein, 72 aa, Proteus mirabilis
LRERYIVDKPSENTDTGKLKLAFAWKPSPLLEEDAYLIPKPVDKGRCSPKTLFTLPTMDLYFDDISIPPRKL

SEQ ID NO: 7462 - protein, 425 aa, Proteus mirabilis
SNIFRRYFVTKTKWTCIRNTQCLPRRILVSFFMDQSIIGNMKRLQAFKFQLRPNGQQEREMRRFAGACRFVFNRALARQNENYEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYRNSREVVGEVRNVTVSQSCGKWYVSIQTEYEATEPQHESTSIVGLDAGVTKLATLSDGTVYPPVSSFKVNQRKLARLQRKLSRKITFSANWQKQKRKIQRLHTHIANIRKDYLHKVTSEISKNHAMIVIEDLKVSNMSKSAKGTTERPGRNVKAKSGLNRAILEQGWYEMRRQLEYKQLWRGGQVLAIPPAYTSQKCACCGHTAKENRQSQSQFECLECGYTANADINGARNILAAGHAVLARGGRVQ

SEQ ID NO: 7463 - protein, 70 aa, Proteus mirabilis
FYFRIPKKLQRMNNKVAGICAGIAIIGIVFSFFFSIYVGLDLTSKGYYRCYKSSAFAPNEYVIAKEMCKK

SEQ ID NO: 7464 - protein, 373 aa, Proteus mirabilis
ASLRSRKMENIQSKKEKIMQLVMVYTPWITVICVVAFIGIATADWDRWWSDARYQTTDNAYIKADSTILKSRMTGFISQINKEDYQVVKRGEVIAEINKKEQILNRQAALAEYQKAQLALDNLTEEIKEYQLNIEKLANRYQASVIDVTQAKRSPMLRKDLINSGAITQQNYLDAQSDLQRLMKLQSAAKNEWDQAKQALVLLKSQEKIRLAQKDIAQTQYQQAETELSYATIKAPFDAQLNKIKVNIGSLVTAGSEIVTLTPINDVYIIANLKETQIKKVQPEQSVAIKVDAFPTDVFSGKVRYIGAQSSGESALIPADNASGNFTKVVQRIPVYITLNSDNRHLAKLRAGMSVQVKIDTDSLPIEEGERSD

SEQ ID NO: 7465 - protein, 143 aa, Proteus mirabilis
QGIRCDYLRVHIMYDDIDNLKNKFQEEGFTFQDFSSQTTGNIACNIGNSVINQQDNKGSLSGDNEEFLNISKVKKRQKQTANIATSLSYSQDLASELKEKNRVNKQSKCLLDNQLFEKKTTDKCQVNEKLSLQKIFSFIASAN

SEQ ID NO: 7466 - protein, 390 aa, Proteus mirabilis
LIDRVRCTLSCLGCHMKFDIAVIGAGIIGLSHAYAAAQRGLRVAIFERSYTPVGASVRNFGHGLILGQAPGKMLDLAKNSREIWATMAKQAKFLTRQKGTYLLARTQSEQAVLEAFVDGRAKTYGYDCELLSKTQLAMVYGGQLQHHKAALHGKEDQVLFSREAIPQLAAYLGSLANVTSYFSTLVRDIDVDTGTLITSNGTFSAEKIIVCSGHDYQTLLADEIKKLDPIVCRLQMLRVTAEQNIGLAHALMTGLSCTHYGAFADLPEAQALAKEIKMQSPLIEQYGIHLLITPTPYGDLIIGDSHEYSLDAQPFNSEEVDNLLIELAEHTLGCSVQVKERWQGVYGAKGKEPISILTPSEKVTAVLMRTGLGMSVGPGLGEQNIRQLFD

SEQ ID NO: 7467 - protein, 662 aa, Proteus mirabilis
YYVREGVSFMHLNPLKISISPSSLPCTQPLTCIEYEDLKDGMLDMINRNSNILPTVVDEFNQQDPLNAPIMVGEVVVGHIIGLIPVVGGVLSKITSALFGLMNKNMKDSSLAEQIIAHVSRIIDAKITDNNIKIIKLTTEGISDVYQLFSDSLARYLDPNVHYSETQLRDLREQVLNRFDDVISTIIAQQPLVLNLAQSAGLPFYCHCCALFVAAHCDILTNKEKLALEEDYFKNNLKTLRNSIDKFNANIHKAIYQQTSQVFKDDYNKCNTFLVGIYTSGLSFYQTWVKRSFEIEFTTPFARWNSLELYGNDYSHDPKISYYKTYVEMGKDILHRTSMLQSIESYSHIDAVIRLKQNYLTPEKEVDSFQYEGCNGVAGDSHDVIKNDTFFTPDSQKAYLSPTQILPSVRYISDTPWGGLKYMVLDDVNNNSFTIGQGNRDNKSYLNIPGYCFNGVNLYLSRHNGKSCQADSGAWLTESAPIFRFYDGYASLPLDTKNHLPTAKKSYELDLNHGFMTQLSKAQYGYSDMLVGKNCILLNHDAYFCLPSEEPIGKVGLSQKITLLLQCAITQEQSLAIVARTGDATQGTIIGSAEFKLTTDQDNIIYKITPLLNHPISDNKSYFYTYQIDLSCIFSQEDQKNLYFHLYFFEPNTLLADMTVLF

SEQ ID NO: 7468 - protein, 387 aa, Proteus mirabilis
RTSRYNSETLVMKKLKVVSVVGTRPEIIRLSRVLIKLDQFCEHIIVHTGQNYDYELNEVFFNDLGVRKPDYFLNAAGTNAAETIGNVIIKVDQVLEKVMPEAVLILGDTNSCISAIPAKRRKIPIFHMEAGNRCFDQRVPEETNRRIVDHTADINLTYSDIARQYLLSEGIPADRVIKTGSPMFEVLSHYMEQIDNSKVLSQLNLKSGEFFVVSAHREENVDSPKNIMKLTNILNTVAEKYNLPVIVSTHPRTRKRIDDHGITFHSNIQLLKPLGFHDYNHLQKHAKAVLSDSGTITEESSIMNFPAINIREAHERPEGFEEASVMMVGLECDRVLQALNILSAQPRGNERLLRQVSDYSMPNVSDKVVRIIHSYTDYVKRVVWKEY

SEQ ID NO: 7469 - protein, 78 aa, Proteus mirabilis
VMTSGANAALNTPKATISKAIDNITFNPSLKAKSQFMRTEASFSSTFCKRSNNKNAILGNQHAIPPKKAEKLQSVLLK

SEQ ID NO: 7470 - protein, 143 aa, Proteus mirabilis
KLKSRETLVMVKINSLKMYLIAIFLFSLALFCFYDSIIYYKNYFMMKDRILFSFQTGLFFFAAPLIIYFSYLIFICGYTKKTQKMNNKVAGICTGIAIVGIVFSFFFSIYVALDLTSKGYFSCYKSSAFAPNEYVIAKEMCKK

SEQ ID NO: 7471 - protein, 372 aa, Proteus mirabilis
HWLSIITIKCRQNKMKLKKLKWVHYFLNLYNPLFGKMKKTATFSSDIKFNSIVIFSTTALGDFMFNTPAIRAIRAHYPDAHITLVSSVKNKLLVENYEQIDSVVYWDNKIRNLLPVALQAKKYKPELAIILHSHLPYDVLFAVMAGCQYILRNTFHVIPEWFRKWIIAEHQPSQYHVIQSKLNIIRYLGIDCSDTRMELPCKIEPLAQSNNSIVGFQMGASTQERRWPVGSFVELAKKLIDSAPLLQIKLIGSSRELELPEEFFALLPERYHQNIENLVGKTSLPDLLSQIKTMAVLVTGDTGPLHLAIALQVPTVSLFVTANPKWTGPYQDLDIHTIIHKIPQQDENRALSMDLITVDEVLTAVNNTLKDK

SEQ ID NO: 7472 - protein, 308 aa, Proteus mirabilis
NVMSIRIVPKEQLGKEPSEKSISFIPPVLFPNLKNLYQRRAERFQALAKDNPFADYLEFAAEIALAQEKALHDNPLELDLTPLLSQQTGIAPLDKKTFKRSKHWHALLASIIAELQSVVPESAKIALENLSKASETELEEMATALLNDEYSKVSADKSVFIWAALSLYWAQLAANIPGKAKTEYGENRQFCPVCNSMPVSSMVQIGTTQGLRYLHCNLCETEWHVVRIKCTNCELTGKLNYWSLDSENAPVKAESCGDCGSYLKILYQEKDANVDAVADDLASLILDAKMEEEGFARSSINPLLFPNE

SEQ ID NO: 7473 - protein, 377 aa, Proteus mirabilis
LQMSKSVLSILHTESSCGWGGQEIRILTESQGMVQRGHHVTLVCCPNSKIAKAAPDYGIEVVTLPIEKKRGSALMALRNWLKVHRQQFDVINTHSSTDAWLVALSCASLRHSPAIVRTRHVSTDVSRSLPTRWLYLSSSAHIVTTGEKLRQTLHQYNRFPLSQMTSVPTGIDLEKFSPQNKQQAREKIGVPNKPTLGIVATMRVWKGHKYLIEAWKTLHLQFPDWQLLLVGDGPQRKNLQPMVKLAGLEESVFFLGNRNDVPDCLNAMDLFALPSFGNEGVPQGIMQAMACGLPVVSTTVGAISEAVIDGKTGFTLAPKVQETLINYLAKLMASDELRQQMGQASLAHAKAQFGLDNMLDKMEKIFINAISLKDKSR

SEQ ID NO: 7474 - protein, 204 aa, Proteus mirabilis
KIKRLKMDKNIFLSASIPLPDRDPKFIESADISAIRDSVNALSKLIIPKAHLIWGGHPSITPLIKFTLKQLGKNAQDHVTLYQSKLFEEFFPEDNASFANIKLVDSVNNDRKESLLAMRNEMLSKDKNFIAGIFIGGMEGVIEEMKLFQKYHPDTPIFPIATTGAAALEIYNMNPIVYPEEFKDELINNYAYLSLFIKLLGNKL

SEQ ID NO: 7475 - protein, 163 aa, Proteus mirabilis
PRKRYCAVNLNATILGQAIAFVLFVLFCMKYVWPPIMAAIEKRQKEIADGLSSAERAKKDLDLAKADAGEQLAKAKAEAQAIIESANKQRTQMIEEAKAEAEQERSKIVAQAQSELEAERKRAREELRKQVAMLAIAGAEKIIERSVDEAANSDIVDKLVAEL

SEQ ID NO: 7476 - protein, 511 aa, Proteus mirabilis
RRGSAVIKLLSAAQNHRPIFVVMAVFTGAILSTLFVRMFSISLADLRGVFGLDVAQGSWLNVALNIAQLISMTLVPWFMVVYGAEKILISASFILFCCGLAVPIIGQQIGFGGLFIAHFMIGFCIGVYLPMTISLALKSLNPSVWLIVMAAYSLRVSVGMDAGVGISGEFVDILNWRWIYWLSAIFTLVILFFTWWGMPLSPINKSLLAQSDWGGMALKCLGLTLLYIGVVQGELLGWWDSGLVVSCLIGSAILMGTFIIRAYIYKQSFGHLNWIKDSNLRLCFIIACLYGFLMLPNSLFIPSFLSVVGGLKPLQIGQVTNLAFFIYLLCSPIAIFLARRLEPRLMMLIGIMIIGGACLIGHQIDYQWRANDFFIVISMQAMGECLLLIGLIASFVTNIKPQEALHLGAYISIARVLMPALAGAIINTYLRISYDTHYDLLRGYIQTGEQKLAGNIAEHYQTTMALVIREAHVASFIDGFDLIMLLVILGALCMSFLKSSPENPVVPRLVK

SEQ ID NO: 7477 - protein, 435 aa, Proteus mirabilis
RYFGQMAEKKDLQNTTHRTYRVFSLPLITLLISTSLFSATSAFANTLTDNRSQLKDLQTTIAEKEKRVQEQQKQRTALLGQLKSQETQIANASRSVHETQNRLQTLAKEIKTITANIARLQKQYNQQQALLARQLDAAYRQGKHQGIELLFRGEEGQREERILAYYSYINEARKQSMEQLAQTSKELQAEKDAQQAKQNEQKQVLTKQQQEKQKLDNALAARQKTLTQLESTLKEDQRNLATMRANETRLRNKIAQAEREAKARAEREAREAARIAAKQREAQQRGSTYKPTAEERSLMSRTGGLGKPAGQAIWPIRGSLLHRFGESISGSGELRWKGIVIPAAQGTEVKAIADGRVLLADWLQGYGLVVVVEHGKGDMSLYGYNQSALVNVGQQVKAGQPIALVGNSGGQERSALYFEIRRQGKAVNPVPWLGR

SEQ ID NO: 7478 - protein, 269 aa, Proteus mirabilis
VNYGHLLLLNKRYMYIMNIFITDFYHRSDLLDKAEAMIANHWPAFMMGTSVDDSYWERLYDVPFSHYQFMAVLKTQTEEKVIGVINSIALPWQTNSLNDLPDEGWDRVFQLGMEAEEQQLPCHLISALSVTIDHHYRGKGIAQRLINTLKEHAKKQGYLGVAVPVRPTLKHCYPLHSFAEYCQWKNDNDEPFDPWIRTHWRLGATTIKIAPQSMKIEAPTEKWQQWTSLRFPVSGDYTIPMGLAPLNIDIQRQYGVYLEPNLWMFHHIR

SEQ ID NO: 7479 - protein, 378 aa, Proteus mirabilis
TRYGRCILRICLQLKYLIEAKVIMNNINQSFNRILVIKLQHHGDMLLTTPVINSLKSAYPNAKIDVLLYKETLPMLEHNPLINHIFYLDRNWKYQGKFTRLKKEWQLGKILQKQQYDLVVNLADQWKAAIFALVTKAPVRLGFEFEKRQNSKFWQKCHNIIVPTAEHGQLHTVEQNLSILAPLNVPIISDVTMAYSHQDKQWLEETIKKHHIPKNYIVIQPTSRWFFKCWDEDKMATLITQLQQDNYSIVLTSGPEAKELEMIENILAQCPDKTSINVLAGKTSLSQLATLIDHAALFIGVDSVAMHMAAALKTPLIALFGSSKLEHWHPWQAIGETIWAGNYAKIPHPDQIKTDTQQRYLSAIPVDAVFNAAKRYLS

SEQ ID NO: 7480 - protein, 472 aa, Proteus mirabilis
KKDGICYMLKSAKNMSGLPWIAAMAFFMQSLDATILNTALPDIAKSLNHSPLAMQSAVISYTLTVALLIPVSGWLADRFGTRKIFIIAVSLFSGGSLLCALSPNLAFLVISRVIQGIGGAMMMPVARLALLRAYPRSELLPILNFVTMPGLVGPIAGPLLGGILVTYASWHWIFIINIPIGLLGIFYAIKHMPNFTMPKRKFDLLGFIFFGFGLVMLSVSLDLFGDKNISRYIPLAVILGGFFLLGLYINHAKRHQQPLIPLNIFKTRTFSVGIAGNIATRLGTGCIPFLMPLMLQVGFGYPAIISGMMMAPMALGSILAKSFVTKVLVTFSYRRTLFGITIIIGLMIAQFSLQSPDMSIYYLVLPLFLLGVVMSIQFTSMNTISLADLTDNNASSGNSVLAVTQQLAISFGIAVSASILNYFDAENAGSTVDNFHYTFITVGAITLLSSFVFLLLNKHDGDNLTNKKKNEN

SEQ ID NO: 7481 - protein, 257 aa, Proteus mirabilis
AVLGRIMRPQYVRESGDNTMRPADRQADQVRPITITRHYTKHAEGSVLVEFGDTKVLCNATVEEGVPRFLKGQGQGWVTAEYGMLPRATNSRNAREAARGKQTGRTMEIQRLIARSLRAAVDLKALGEFTITVDCDVIQADGGTRTASISGACVALVDALNKMVTEGKLKKSPLKSMVAAVSVGIVDGQPLCDLEYVEDSAAETDMNVVMIDDGRMIEVQGTAEGAPFSHEELLALLALAKGGLEKIFEAQKEALKQ

SEQ ID NO: 7482 - protein, 281 aa, Proteus mirabilis
ESRGIIALINLTLSLSATTESLMSESKRLSVVMISKNVADVIEACLDSVQWADEIIVLDSGSDDATCQLAREKGAKVFSNTPWPGFGKQRQLAQQYATGDYIFMIDSDERITPELKASIQAVLQQPESGVVYNCARRNLFMGRFMKHSGWYPDKVTRLYAREQYQYNDNLVHESLETQGATIKTLPGDLLHLTCRDLIEFQQKQLKYAKAWAQERNQQGKTTRYSAIISHTLGAFFKTWLLRMGILDGKQGLILAFVNAQYTFNKYASLWELSRKNREYEK

SEQ ID NO: 7483 - protein, 181 aa, Proteus mirabilis
GGRGMSEIATVARPYAKAAFDFAVENQAVDKWQVMLAFTAEVARNEQVTELLSGSLASEKLADIFIDLCGDQIDEHAQNLIRVMAENDRLSTLPEVLSQFIQLRAVLESTVDVEVTSAIELTKQQLANISAAMEKRLSRKVKLNCKIDKSVIAGMIIRAGDLVIDGSVRGRLERLTDVLQS

SEQ ID NO: 7484 - protein, 248 aa, Proteus mirabilis
IFFIKKQNTSKNDGYNLINYYTAIGGCMFKKYLLAISLLALSSGTTLAANPIAKLKVTGRIKPPTCTINNEEQEATIIYNFDITPGLFPEKGDLKLAGQSKNIVISCDSSTYLAFVATDNRLGTQSQESEAFFGLGHYQFKNKDDGKNAETKVGYYTINISNATVKKEDGSKFEKAYIKSNNATTSVPNTLIHKQSEYGWALPGKTSVAGKSFAADFEVKPVINSQMKKIEGEAELDGLATLTFQFGI

SEQ ID NO: 7485 - protein, 215 aa, Proteus mirabilis
ELFMKSPKIDRLNVLDTALSLLEKEGIEGLTMRKLADALHIKAASLYWHFDNKQTLIEGMADRIVSEVAVDFHYSQDWKADLKRLATELREAFLQHRDGARVFAGTYVISENVLRINNTLITLIMQSGASAELASNMSMTLLYFILGCCIEQQAITLIDSEILMQKRLAFEQIVRDKYPQTWQVREILFADDFAMRFNFGLEQLVTGFEHQLMTP

SEQ ID NO: 7486 - protein, 353 aa, Proteus mirabilis
SRFMKIFVVGPSWVGDMMMSQSLYRTLKALHPAATIDVMAPAWCRPLLEKMPEVDNAIAMPLGHGALAIGERRRLGKQLKAKGYTHAYVLPNSFKSALVPFFAAIPKRTGWRGEMRYGLLNDLRPLDKAAFPLMVERYVALAYDKQQVHSAADLPKPLLWPKLAVSDKDITTTLKHFSLSTQRPAIGFCPGAEFGPAKRWPHYHYATLAQKLISEYGYQIFLFGSQKDKPAGEEIKHALTPDAQAACINLAGETSLEQAVNLIAACKAVVSNDSGLMHVAAALERPLVALYGPSSPDFTPPLSDKARVIRLITGYHKVRKGDAEQGYHQSLIDIQPEQVFSELEQLLATEPSL

SEQ ID NO: 7487 - protein, 181 aa, Proteus mirabilis
FLLIFISKRYIILGDFMTRKVFFSFHYQPDNWRVSQVRNIGVIEGNQPAKDNDWETVVGGGDTQIKKWISAQMEGRTCTVILAGQDTANRKWINYEITQSWDEGKGVVVIYIHNLKNAQGEQSNKGENPLDFIRHRDTGKKLSEIAKAYDPPYLTSKFVYEYIEKNIDKWIEEAIKIRKEN

SEQ ID NO: 7488 - protein, 290 aa, Proteus mirabilis
DPIMIRSMTAFARRDIKKEWGSAAWELRSVNQRYLETYIRLPEQLRSLEPVIRERLRNRLTRGKIECNLRFELNAHSQGELTLDENLARQLIVSANWVKSQSHEGTISPFDILRWPGVISAQEQDLDAIGSELLAELDVAIDAFIASREAEGQALKTLIEQRLDAVSAEVVKVRAQMPEILQWQRERLTSKLEEAQVQVDNNRLEQELVMLAQRLDVAEELDRLDAHVKETRKILSKKEAVGRRLDFMMQEFNRESNTLASKSINTDVTNSAIELKVLIEQMREQIQNIE

SEQ ID NO: 7489 - protein, 155 aa, Proteus mirabilis
PNIMMKKIDVKILDPRIGQEYPLPAYATTGSAGLDLRACLDAPLVLAPGQTELLPTGLAVHIADEGLAAMVLPRSGLGHKHGVVLGNLVGLIDSDYQGQLMVSVWNRGQQAFTIEPGERIAQMVIVPVVQAEFNIVEDFTATERGTGGFGHSGRQ

SEQ ID NO: 7490 - protein, 138 aa, Proteus mirabilis
IKVIKMRYIDNLSLANLYKEAEKSERLRAHLLLHQSHKDKVQRLLIALVKGSYVEPHYHELPHQWEMFVILEGTIEVALYDHMGEIIESFLAGENTDTSIVNLEPNEVHSIKCLSEKALMLEVKEGPFDANYAKKFLN

SEQ ID NO: 7491 - protein, 148 aa, Proteus mirabilis
LHPMLQEVMQFFSRHTLLSFIWIALLVAVIVLTFKGLFSKTKNISRTEAISLINKENAVCVDIRSRDEFRKGHIIDSINLTPSEIKSNNIAELEKYKSQPVIVVSPSGIEGAKPAESLIKLGFEKVFILKDGLSGWSGENLPLAKGKK

SEQ ID NO: 7492 - protein, 422 aa, Proteus mirabilis
AFNILNKQILHNAIWMMSEKAVSIIGLFLVTSYVARYVGPETFGIIALATAIFQVVQIIAQLGNDNIIFKRVSKNKQSGIKLIKSTFFIRSFIYITITIPLLIYFYSYKDNFTFLFSLAISIACYFSSIDVYSIYNNAILKSKKNTISNIVGLSLGLSLQFIIAHNKYNPIYLSIPIIITTFIPFLVRFISFHKMKIVKQTTVNKKIKYNRYILSSGLSIVFSSLSIAIYTRINQFMISYLDGEYSLGIYSVAIILSSSWAFVLTSLISSTLPSIFGEKDDNRAIKIGIKLNIIIIVISLFVLSFILLFGEFFINLLFGEKYIPAYSLLKILCISTMFANLGTLSARFIIRSSGYSFLSKKMFIMVLLSIPISYYLIKSYGLIGAAYSVLIIEFLSLTLMNYFFKNKIIWKLHIATLKMNFK

SEQ ID NO: 7493 - protein, 344 aa, Proteus mirabilis
GSNMKALSKLKAQPGIWMTDVPVPELGHNDVMIKIRKTAICGTDVHIYNWDEWSQKTIPVPMVVGHEYIGEIVAIGQEVKGFNIGDRVSGEGHITCGHCRNCRGGRTHLCRNTIGVGVNRPGCFAEYLVIPAFNAFKIPDNIPDELAAIFDPFGNAVHTALSFDLVGEDVLVSGAGPIGIMAAAICKHVGARHVVITDVNEYRLDLAKKMGVTRAVNVSKENLTDVMKELGMTEGFDVGLEMSGAPPAFRTMLSTMNHGGRIALLGIPPSDMAIDWGKVIFKGLFIKGIYGREMFETWYKMAALIQSGLDLSPIITHQFPIDEFQKGFDIMRSGQSGKVILDWQ

SEQ ID NO: 7494 - protein, 306 aa, Proteus mirabilis
ETDMYYGFDMGGTKIELAVFDKDLTQVWQKRVPTPKNDYQALLNVFKTLTLEADNDLGCKGKIGIGVPGIVNAKEGTVFTTNVPAAKYKPMIHDLANILERPVKVENDANCFALSEAWDPEFRHYPSVLGLILGTGVGGGFVIDGKVLSGKNGIAGEIGHMNLNVDADNVIGETMPKILCGCGRKACFETYLSGRGFERMYKAFNGSPQRAVDIVAQYYQGDEQTQQHVDRYMKVLAIYLSNILTVLDPHLIVIGGGLSQFDALYTLLPDYLSHCVYGNTQIPTIEKARYGDAGGARGAACLNLLD

SEQ ID NO: 7495 - protein, 204 aa, Proteus mirabilis
KQCMMRRDPMQVSRRQFFKICAGGMAGTTAAALGFAPAVALAGSRQYKLLRARETRNTCTYCSVGCGLLMYSLGDGAKNAKETIFHIEGDPDHPVNRGALCPKGAGLVDFIHSKGRLQYPEYRAPGSDKWVKLSWEETFDRIARLMKKDRDANFEKFNKEGVEVNRWLSTGMLCASAASNETGFLTQKFSRALGMLAVDNQARV

SEQ ID NO: 7496 - protein, 389 aa, Proteus mirabilis
EKCMNHVYQLVLLGDKEKYEKPIVNWLLIQTKILGIQNEFIKVINRLNFNEYLPNNPTYGLYFGSENTSLDQNILNTLIDDATLILPIIPDLSLANHYLPKELHPINAIAMKSINDIPTITSAILEGFELLRQSRKLFISYKRSESSTVAIQLYEVLEKFGFDVFLDTHSIRPGEPFQEELWHRMTDSDIVILLNTPDFLGSQWTQEELAKASAMSLGIIQIIWPDCTPLRESELFRTIKLQRESINNQGHLSEFIIKQLISETESLRARTLAARQDNLTTEFIDISHKLGVKSILHTDKFITFSINDRNYVVIPTVGVPQSFTSNNIYTLRQKICKDKIEEIYLLYDHTHIRKKWLAHLSWLDEYLPVKTLRLLNIQPFIENQEIKNG

SEQ ID NO: 7497 - protein, 471 aa, Proteus mirabilis
GECMEKSKKIKWAMPDAFIIIFGIVILAAIATYLIPAGSYQRETVNGLNRVVPNSFNYVAQNPASLMDVFYAIPVGLKQSASIIFLIFMIGGAIAIYDRTRAIDSGINALIVKTKGNYQALIITVAFIFGMLSSLGLAANAVIAFIPIGIALSRSMKLDAITGVAVVYLGYYAGNAVGVLDPTILGTAQTLAEVPLFSGVIFRVVLFAILIVVTIAYIVWYARRIANDPTTSYMYGIAKDDPDYEQPHTQSLDSTFSLRQKLSLVVFIAFIGLFLYGAFEYKWGIEHLSAIFIMMSIVVAAMFKIAPNDYIKTFMKGAQSLVYGALVVGIARAVIVILDEGRVLDSIVQATLVPLQQTSHFWGAQLLYFFNLLFNLLVTSGTGQASIVMPIMVPILDILDLTRQTGVLILKLGDGFTNIITPTSGVLMAVLAVGKVPWTRWVKFVFPILMIWVVIGMAAIGIATAISYGPV

SEQ ID NO: 7498 - protein, 311 aa, Proteus mirabilis
GNIMEAKKLVILGSVNVDHILNVAHFPHPGETISGNQYQMVFGGKGANQAVAAGRCGANITFLACLGNDDIGQSAKAQLITDKIDTDCIELIDDEATGVALIFVNQQGENVIGIHAGANGRLNREYVERYNSVIKKADALLMQLESPLDSVLKAAQVAKQESVQVILNPAPAQALPDELLSLVDIITPNETETEYLTGVKVIDDESAQRASNILHDKGIETVLITLGSRGVWVSQNNQGTMVPAFKVTAIDTIAAGDTFNGAFITALLEGLPMMKAIKFAHAAAAIAVTRAGAQPSVPWRHEIEAFLSQHD

SEQ ID NO: 7499 - protein, 635 aa, Proteus mirabilis
GSHMFYPEHFDVIVIGGGHAGTEAAMAAARMGRQTLLLTHNIDTLGQMSCNPAIGGIGKGHLVKEIDAMGGLMATAIDHAGIQFRTLNASKGPAVRATRAQADRVLYRQAIRTTLENQPNLMIFQQPVEDLIVENDQVTGAVTRMGLKFRAKAVVLTVGTFLDGKIHIGLENYSGGRAGDPPSVSLSHRLRELPLRVGRLKTGTPPRIDARTIDFSQLAPQLGDNPMPVFSFLGNVDQHPEQMPCHITHTNEQTHEIIRNNLDRSPMYAGVIEGIGPRYCPSIEDKVMRFADRNSHQIFLEPEGLTSNEIYPNGISTSLPFDVQMQIVNSMKGMENAKIIRPGYAIEYDFFDPRDLKQTLESKFINGLFFAGQINGTTGYEEAAAQGLLAGLNAARYAFDQEGWFPRRDQAYIGVLVDDLCTLGTKEPYRMFTSRAEYRLMLREDNADLRLTEIGRELGMVDDNRWAQFSEKVELVEKERQRLRDIWVHPKADNLEEINQLLKTPLSKEANGEDLLRRPEMTYEILKKIPRFAPGIDDSRPQAAEQVEIQVKYEGYINRQQEEIEKQLRNESAVLPIDIDYKQVSGLSNEVIAKLNDHKPTSIGQASRISGVTPAAISILLVWLKKQGLLRRSAS

SEQ ID NO: 7500 - protein, 89 aa, Proteus mirabilis
RVDINNDKKIIVNNRFFDFLEPIINNSRILIIPNIYCCLALIGITISENIVINKKAVINSLNNLCITPYLAIAIILFFKKKFILGTIDQ

SEQ ID NO: 7501 - protein, 339 aa, Proteus mirabilis
ENRMMLKKLILATSLLFSAGTVFAATEITVYTAIESEQLQAYKQAFEAKYPDIKIKWVRDSTGIITAKLLAEKDRPQADVVWGLAASSLAILKAQNMLEPYAPAQLDDIDVKFRDSNNPPTWVGMDVWAATICYNTIEAQKLGLSKPTSWQDLTKPEYKGKIVMPNPASSGTGFLDVSAWLQIFGEQEGWAYMDKLHQNIGQYVHSGSKPCKMAASGEYPIGISFEYPALQLKRQGAPLDIILPQEGLGWDIEATAIIKGTNKRDAAQKLADFSASKEAMKLYSANFAVLANTSVPVSQTELPRDYAQRLIKNDFIWAAEKRDTILTEWRKRYDGKSAK

SEQ ID NO: 7502 - protein, 175 aa, Proteus mirabilis
LYLIILLFMLNIVLFEPEIPPNTGNIIRLCANTGFHLHLIQPLGFTWDDKRLRRAGLDYREFADIKQHHDYYAFLESEGLSPDNAQSPTGARLFALTTKGTPAHSNVSYQDGDYLLFGPETRGLPPYVLDNMPTQQKIRVPMLADSRSMNLSNTVAVVVFEAWRQLGYPGALLRD

SEQ ID NO: 7503 - protein, 340 aa, Proteus mirabilis
RSLMNASMTVIGAGSYGTALAITLARNGHDVVLWGHDPKHVAALEQARCNQAFLPDVSFPDSLYMEASLQKAIEASRNILVVIPSHVFGEVLQQIKPFLRQDARVVWATKGLEAHTGRLLQDVAREVLGNEIPLAVLSGPTFAKELAAGLPTAIAVASTDNLFLEQLQQLFHCGKSFRVYKNPDFIGVQLGGAVKNVIAIGAGMSDGMGFGANARTALITRGLAEMSRLGKALGADAATFMGMAGLGDLVLTCTDNQSRNRRFGMMLGQGLDVDTAQEKIGQVVEGYRNTKEVRALAEQVGVEMPITEQIYQILYQHKDVKEAALALLGRATKDEIDSSL

SEQ ID NO: 7504 - protein, 280 aa, Proteus mirabilis
SYVINNKEVIMKKINIFTGTLFVLSSISMAQAEIHSNQSGPLTTMSVGASDPVTRGPHQSAGGEPGVGISNLYGGKKIGFASLTPNNMSGGADSHGVYTIQPNENTPASHSNMGVFHFSQVTDANVYFGTWAKTASVTDITHQSYYVGKEVTSTLPTDSATYTVTGISQYSGDNLLSGTFDVDFSQKTIGGSLANNLRTVELERGNIYTANNQVTFSADAKEDTTSGIVEGAFFGENAETLAGIVVFHTDHTKDIGFGGSKNSAEVDTATDSVTDSAEAS

SEQ ID NO: 7505 - protein, 152 aa, Proteus mirabilis
MSTISMAVSVQLIEQEHYAQWLAYWLSYQEFYNVELSEEITLKTWARFFDEKEPIYCAVATDGKKIMGFVHYLFHRSTWAESDFCYLEDLFVSPEARGCHVGKKLIDFVNQQAKQRNCARLYWHTQETNLRGQRLYDWVAEKPGVIEYRMAL

SEQ ID NO: 7506 - protein, 366 aa, Proteus mirabilis
YYKIMKRILIITNYYFPAKKAGGPVKSIKNLVSFLKEKYSFNIITSNRDLDGAILNTKNSEDISYTKNTYEIIYLLLKKINNVDIIYLNSFFSFKYSILILVLNSLGLCKNKKILIAPRGELSNGAVSIKKRKKIFYIRCFKYFLKRKNISFHFTTVEEKNEAIAMLGNIKHKVAPNCHDKIPAYIKKKKERNELKIIYLSRITPKKNLLILSKILSEINSNIQFTIVGNIEDSSYFKECMLILNKNKLITTKYIGAVSPEKTSTLLQDSHLFALLTLNENYGHAIVEALTHSNLVLLSNNTPWSNLSNYNCGIFDPDSIDECKLYINKIFEMDQIEYNQYTYRTYQYISNILSINEKFIEETFSD

SEQ ID NO: 7507 - protein, 304 aa, Proteus mirabilis
EEKMSELVINNNIVNDLLIKQFTNYVFMMIVTDIKGNIIYANKKYCQFNHINFESIKNKRYNLFYLVDENQDVFSNISDNKEVIRLEAKHPNKNKQEVWEDINIVPIFDKNNLISHYAFLSLDITDKVKLRNDLLTKSYIDSLTGMANRLSIIEKIEQERLNIATPSSFCLGIIDCDKFKTINDQYGHAIGDHVLCEIAQRLLALERQQVYCGRLGGDEFAVLFPAGLRSCSLLLLEIIESLWRGMEKPIKINKEKTIVPSISLGIAEYPKDGKTLSELLKSADKQLYAIKEKGGNKYGFYSEY

SEQ ID NO: 7508 - protein, 75 aa, Proteus mirabilis
ASEMARCYSVILRNNTLVFWHHNSNKKEYLCWLEPCLSLFHSLYSPYLAIVGQEMVWWIEHGQLQEWIAIVIAKR

SEQ ID NO: 7509 - protein, 813 aa, Proteus mirabilis
TIGIKRETLMSNTYDSSSIKVLKGLDAVRKRPGMYIGDTDDGTGLHHMVFEVVDNAIDEALAGYCDEIIVTIHSDNSVSVRDDGRGIPTGIHEEEGVSAAEVIMTVLHAGGKFDDNSYKVSGGLHGVGVSVVNALSEKLELTIHRDGKIHQQIYRSGVPDDRLKVIGETDKSGTFVRFWPSLDTFKGETEFQYDILAKRLRELSFLNSGVSIRLIDKRDNREDHFHYEGGIKAFVEYLSRNKTPIHQNVFYFSTEKDGIGVEVAMLWNDGFQENVYCFTNNIPQRDGGTHLVGFRTAMTRTLNNYMDKEGFNKKSKISATGDDAREGLIAVISVKVPDPKFSSQTKDKLVSSEVKTAVETLMNEKLVEYLLENPTDAKIVVGKIIDAARAREAARKAREMTRRKGALDLGGLPGKLADCSERDPAFSELYLVEGDSAGGSAKQGRNRKTQAILPLKGKILNVEKARFDKMLASQEVATLITALGCGIGRDEYNPDKLRYHSIIIMTDADVDGSHIRTLLLTFFYRQMPEIIERGHIFIAQPPLYKVKKGKQEQYIKDDDAMDEYLMSIALDGAALYVSEHAPAMHGAQLEKLVVDYHAAHKIIRRMERLYPLSMLNSLVYHSTLTEDDLSDKAKVEEWMSGLVNRLNNAEEQSSTYSYTITQNEENRLFEPVLRIRTYGIDTDYKLDYDFIHSSEYQRITNLGDIIGNLIEEGAYIERGERLQAISSFEEAIEWLTKESRRGLAVQRYKGLGEMNPEQLWETTMNPDTRRMMQVTVKDAIATDELFTTLMGDAVEPRRAFIEENALKAENIDI

SEQ ID NO: 7510 - protein, 424 aa, Proteus mirabilis
LIMMLFKDDSKKSLWNLSIIGLYIILIYLPDITRYKNIVMGLIGATALWYLVRDFRTIGQIFKNNLAYALFFLLLAIGYSVVISVEPVLSLKEMNKPILNGLLLFAIAFPIVLYKETPTAIAKMVMVSFAMGLLVIMAKELVQYYLEYQQNILPFTRKSQLAHREISYALLFFFPIILALWALKKNHSIINWLLLSVVSLLFLFAILGTLARGAWVALAISTLLILIINRQWVLILISILACVLLFISITNLPPNPVVSKFFQYKLTQTNSGLRFDGGTQGSALDLILEQPIKGYGYGNQLYHNVYNQQVKQHKNWVFKKSIGPHNVFLAFWFAGGILGLISLLYFCASFIAQGIQLIRKNQGIIRQASLVLLMSFLGVYVLRGLFENAYINQVGILLGLMLALRYSLLNQPSATPTQEDKSVS

SEQ ID NO: 7511 - protein, 87 aa, Proteus mirabilis
KMMIIINAYQLSVHLKDVRLTKKLSQSKVAQKVGIRQDTVSNFELNPNSTKLETFFKLLSALNLEMEIHPKDAKNNLAHKSEWKEEW

SEQ ID NO: 7512 - protein, 503 aa, Proteus mirabilis
LGAFMQLAERISQLSQYLETGLYERQSAIRLCLLAALSGESVFLLGPPGIAKSLIARRMKEAFKHAKAFEYLMTRFSTPEEIFGPLSIQALKDEGKYQRLTEGYLPDAEIVFLDEIWKAGPAILNTLLTAINERKFRNGENEVSIPMRLLVSASNELPDSDSSLEALYDRMLIRIWLSKVQDKKNFRALLVNKEVSAFRIPEQLQITTDEFLLWQTELEKITLNDHLFELIYQLRDSLDKSDAAPYVSDRRWKKAVRLLQASAFFNGRSAISPLDLILLKDCLWHDQASFALLNDLLKTLLTEQAYHQLTLLQKIENLWAEWMQSTRSKQDQQAFRFEKQSSMFGRNIHFKLSEKMQSDKFTLFLHIPLHIHSIQVNFITVEKKALETFLDKGDELSARLNGIGFPQSINAQIRQDGVLEVLDVSRRTTSLYQQSESIKTEPIEDNQQWLDKLKDLTQEIYSEQENFNHHQPNIFIDNDWLISIEQSFLQLNEKLSQLRSQIK

SEQ ID NO: 7513 - protein, 162 aa, Proteus mirabilis
KGKIIMSEQQNQEMTFQIQRIYTKDISFEAPNAPQVFQKEWQPEVKLDLDTSSNTLAENVYEVILRVTVTATMEEETAFLCEVQQAGIFTVEGIEGTQLAHCLGAYCPNVLFPYARECITNLVGRGTFPQLNLAPVNFDALFMNYLQQQQQQDAANSGVEEA

SEQ ID NO: 7514 - protein, 369 aa, Proteus mirabilis
LMKIGLIDVTITMSYGGIQTAVWELAKQLHDAGHEVHLYGGNGDVRHELAGRQIHIHTYPYTPREKVIDLGGRFRRIVERYSFARYAKQDVIRQNFDWVILTKPFDFFWPAMMPKSCSTRFCYMSGGTSFFKGDRKLAKKISAWVACSHFNAWQIQQHFKQFPAVIYNGVDMAKFKPMTTSLRQQLGVSEPTFLLAFAGRVVGWKGLSVAIDAIAQLRDEDVKLLIIGAGDALEQLKNKAMVKGVAEQVIFHQPVEHAMLPEFYAACDAGVFPSIGDEAFGITIAEAMACGKPVIASYIGGIPEVVGNEQSAGLLVTPGDVTAMVKAINHLRALPDRGKAMGENARQRIASHYTWQHSAQRLLQALKTE

SEQ ID NO: 7515 - protein, 567 aa, Proteus mirabilis
GSEIMSVIVPTKSINRLDSLFVAGGKLFIICLLILGVLLPLLAIFWRGFTPDISQGGGFQAAIDLFTSANFLWLVGNSISVSLSVAVITVPLAYLFAYALHRTLIPFKSLWRGISLLPLLAPSMLPGIALVYLFGNQGLLRSLLTESIYGYWGLVLGEVIYTFPHALMILLSALSMSDARLFDAASSLGASSWRTFRSVTWSSSRHGIFAALCLVFTLTITDFGIPVVVGGDYQVLALEAYKAVLGQQQFGRGALIGMLLLLPALLTFGVDVWLRKRQRDAMSSRAQFYLPKANFQRDTLYLIFVMLICALFLLVFGTAVYSSFIQFWPYNLSFSLRHYNFEGLPGGWLAYTNSIILAFYTATIGCFLIFMGAYLIEKTASHSWLNNLLRMLSFVPMAVPGLVLGLGYVFFFNLPNNPLNFLYGSMVLLVLCSIAHFFTTAYMTASTALRQLDKEFEAASLSLKAPLYRHFWRITIPLCLPALLDIYRYLFVSAMTTVSAAIFLYSPDTILAAVAVLNMDDAGNIGGAAAMSTLILTTSAGVSILLSIASQGVLRRTQAWHQREAKQ

SEQ ID NO: 7516 - protein, 201 aa, Proteus mirabilis
PKNVLKFGEFTLKSGRVSPYFFNAGLFNTGRDLALLGQFYAQTLIDNHVPCDVLFGPAYKGIPIATTTAVALVEHHDMDVPYCFNRKEAKDHGEGGTLVGSPLTGNVVIVDDVITAGTAIRESMEIIKQHDATLSGVLLSLDRQEKGRGSLSAIQELERDYQCQVYSIITLDDLISYLTESETLSAHLPAVKAYRERYGIN

SEQ ID NO: 7517 - protein, 198 aa, Proteus mirabilis
RLIVMDRLWLKRRIYILGGLTILLFLLQIIGSLFPVHLLQYGIIPRSSEGLFGIFISPFIHGSWSHLFSNLLPFLILSFLLMTQSLREYCYSSIFIIIISGLLVWLFGRNAIHVGASGWIFGLWSLLIAHAFTRHKIIDIVIALFVLFYYGSMAYGLIPGQLGVSTESHIAGVISGLLYAWCARKIIRRKSRVVEIIK

SEQ ID NO: 7518 - protein, 157 aa, Proteus mirabilis
ESIVRTLYFTALTTGILSAIWAFVASQFDLLSWAGFLGCTAYFAYPKEGFKGLVVTIATIMSGVIWALAIIYGSQLFNDSAIFGYAVTGVIAFVMCVQAKSTLLAYIPGTFIGACTIFAAQGHLTQTIPSLILGILFGYSMKMSGLWIANKSQKKAI

SEQ ID NO: 7519 - protein, 287 aa, Proteus mirabilis
TVSVFNNKRVIGIMSASGEALTTRDYIGGHLNNLQLDLRTFELVNPHAENTPSFWVLNIDSLFFSVLMGLLFLWIFRKVAVKATSGVPGKFQTAVEMVIGFVDSSVRDMYHGKSKVIAPLALTVFVWVLLMNTLDLLPIDFIPYIGEHILGLPALRIVPTADVSITLSMAIGVFILILFYSIKMKGVKGFTKELTLQPFNHPVFIPINLILEGVSLLSKPVSLGLRLFGNMYAGELIFILIAGLLPWWSQWLLSLPWAIFHILIITLQAFIFMVLTIVYLSMASEEH

SEQ ID NO: 7520 - protein, 493 aa, Proteus mirabilis
LTGFFAFRNILCNEICSIIWHKQVYLPFFTGVIRLIMSNSAKSVVILAAGKGTRMYSQLPKVLHKLAGKSMVQHVIDTAKSLGAQQTHLVYGHGGELMKETLGSQPVNWVLQAEQLGTGHAMQQAAPFFADDEDILMLYGDVPLITKETLERLIAVKPAGGIGLLTVILDNPMGYGRIVRENGDVVGIVEQKDASEEQLKIKEINTGILVANGGDLKRWLAKLDNNNAQKEYYITDIIALAHQEGRKIETAHPTRHSEMEGVNNRLQLASLERIYQTEQAERLLLEGVMLLDPARFDLRGTLTHGKDVVIDTNVIIEGEVTLGNNVEIGTGCVLKNCVIGDGSIISPYTVIEDANLAQECTVGPFARLRPGAQLADKAHVGNFVEMKKASLGVGSKAGHLTYLGDTEVGANVNIGAGTITCNYDGANKFKTIIGDDVFIGSDTQLVAPVCVANGATIGAGTTLTKDVNENELVISRVKQTHISGWKRPVKKKQ

SEQ ID NO: 7521 - protein, 523 aa, Proteus mirabilis
RLAVLRGLEHMQLNSTEISELIKQRIAQFNVVSEAHNEGTIVSVSDGIIRIHGLAEVMQGEMIALPGNRFAIALNLERDSVGAVVMGPYADLAEGMKVKCTGRILEVPVGRGLLGRVVNTLGEPIDGKGAVEHDGFSPVEMIAPGVIDRQSVDQPVQTGYKSVDAMIPIGRGQRELIIGDRQTGKTALAVDAIINQRDSGIKCIYVAIGQKASTISNVVRKLEEHGALENTIVVVASASESAALQYLAPYAGCAMGEYFRDRGEDALIIYDDLSKQAVAYRQISLLLRRPPGREAYPGDVFYLHSRLLERAARVSAEYVENFTNGEVKGKTGSLTALPIIETQAGDVSAFVPTNVISITDGQIFLESNLFNAGIRPAVNPGISVSRVGGAAQTKIMKKLSGGIRTALAQYRELAAFSQFASDLDDATRKQLNHGQKVTELLKQKQYEPMSVAQQSLSLFAAERGYLEDVEISKVVPFEAALLAYASREHADLLKEINQTGTYNEEIEAKLKGVLDNFKATQSW

SEQ ID NO: 7522 - protein, 622 aa, Proteus mirabilis
RHQVRKTHSFRNNTMCGIVGAVAQRDIAEILIEGLRRLEYRGYDSAGLAVVDNDCHMTRLREVGKVQMLAEEAEKTQVIGGTGIAHTRWATHGEPCQDNAHPHVSGTIAVVHNGIIENYQELKAELINRGYQFASQTDTEVIAHLVNWEQRQGGTLREVVQRVIPQLRGAYGTVIMDSRTPELLVAARSGSPLVVGLGVGENFLASDQLALLPVTRRFIYLEEGDIVEITRRHVNIYDVNGEEVNRDIIESNVQYDAGDKGIYRHYMQKEIYEQPLAIKNTLEGRLKAESIDLSELGSKAPEILSQVEHIQIVACGTSYNAGMVSRYWFESLAGIPCDVEIASEYRYRKPATRRNSLLITLSQSGETADTLAALRLSKELGYLSSLAICNVAGSSLVRESEFVLMTKAGAEIGVASTKAFTTQLAVLLMLVAYMGRIKGVEALEQQVAMALHALPSRIESMLSKDKVIEALAEDFSEKSHALFLGRGDQYPIAVEGALKLKEISYIHAEAYAAGELKHGPLALIDADMPVIIVAPNNELLEKLKSNIEEVRARGGLLYVFADQDAGFEESETMKLISLPHVEELIAPIFYTVPLQLLSYHVALIKGTDVDQPRNLAKSVTVE

SEQ ID NO: 7523 - protein, 146 aa, Proteus mirabilis
MKKVTLISGSTMGSAEYVAEHLEEILSKEGFETDLHHGPSLNDLPQEGIWLVITSTHGAGEIPDNLQPFADEISADGIDLSKVSFGAVGIGSSEYDTFCGAIRTLDQKLIEKGAVRLGDRLEIDIQEHDIPEDPAEEWLTTWKNLL

SEQ ID NO: 7524 - protein, 278 aa, Proteus mirabilis
KMRVSMSLEELTRVWDHIKSEARALADCEPMLASFFHATLLKHENLGSALSYMLANKLATQTMPAIAVREIVEEAYSHDSSMIESAACDLSAVRLRDPAVDKYSTPLLYLKGFHALQAYRIAHWLWQQNRQALAIYLQNQISVTFGVDIHPAARIGHGIMLDHATGIVIGETAVVENDVSILQSVTLGGTGKTGGDRHPKVREGVMIGAGAKILGNIEIGRGAKIGAGSVVLHEVPAHTTVAGVPARIVGRPDSEKPSFDMDQHFNGVVPGFECGDGI

SEQ ID NO: 7525 - protein, 364 aa, Proteus mirabilis
IGVVSDMLQFNINSQNGSMPHIRVENIQKRFNQFIALDGVSLEIKQGELVCLLGPSGCGKTTLLRCIAGLETQDHGSIFNYDNNISHLPPQARDYGILFQSYALFPNLTVQQNIAYGLAGQPRNVIKNRVNEMLELVGLQDRKKKYPGELSGGQQQRVALARALAPAPSLLLLDEPMSALDAQVREHLCVELRNLQQSLNITTLMVTHNQDEAMLMADRIAVMNNGKVEQYGSSEEIYNHPQTPFVAEFVGKGNWLPFNRNQHGEAMIGSREVQLKHTAIPHNQGRLFCRPESIKINPIQNKHNQYDANIQNVVFLGSRCIMKFELDHLPGHLLQAEISAAELHSIQNGKVKVTLPANELHIFA

SEQ ID NO: 7526 - protein, 383 aa, Proteus mirabilis
LQEVNKMQHTINSQYDEMVDFLKELVNIDSGSYDKQGVDTVADLLIQRYQKLGFVVEVFENEQLGNNYRLVHKDATNPQIFIAAHLDTVFPKGTVAERPFSIDGSRAYGPGVIDMKASHVLTYYAINALKQSGDLSYQNVEILLNCDEEIGSKTSRHLIEKYAKNKAYALIMEPARANGAIVSARRGVGTYELLIEGKASHSGIAPEAGISAIQELSYKIQALHALSRHDEGLSVNVGLISGGTSVNTVAPHARAEIDVRISTDEQGIEIDKQVREVCSQPVLAGVKLTLKGGINRPPMVKTPESANLIEIIKQQADLIGLAIEDISTGGGSDASFTAGVGTPSVDGLGPIGGYQHSDKEYLDLPSLTERTVLFANVIKRLSQ

SEQ ID NO: 7527 - protein, 184 aa, Proteus mirabilis
KGVFMLARALFIPLSFPLLALSCYCWAGNGLVDRTWTASGMDSYSYRQALRQPTVGSRYTLFNITPDMPTPGGTSPVGTKGIRYIAMKYGPYGQPEHYKTYQVMFSHYSTTTTRKVRYLGELYTVVGDIYLIDPAATTNEWQRGRSQIVEEYYEILDTHGNRTGKGLRFNRWDRPINITNWSTY

SEQ ID NO: 7528 - protein, 738 aa, Proteus mirabilis
LLVFSFFKKFYWSIVPRMNFFLKNKIIAMARYGVMHKLFKLLITAFLLITMFSLIVMPMSAKQQYIFGIINILLLFIIGSKKSKKRLLTMIFLSLLMSTRYLYWRATHTLNFNTSIEGILGTGLFLAEIYSWIILVLGYFQTAWPLNRKIAPLPKDISLWPTVDIYVPTYNESLDVVRDTVLAAQSIDYPKDKMKVYLLDDGSREEFKQFANDVGVTYIEREEHDHAKAGNLNHAMALTDGELICVFDCDHISTRIFLQATVGYFLEDPKLALVQTPHYFYSPDPFERNLSAAKNGPHEGALFYGPVQRGNDNWNATFFCGSCAVMRRSALEEIGGIAVETVTEDAHTALKLQRLGWNSAFIDIPLAAGLATERLALHVNQRIRWARGMTQIFRVDNPMLGRGLTFPQRLCYLNAMMHFQYGLPRIIFLTAPLLFMLFNLNIIASSASMIFAFALPHLIMSVYVNSRNIGKYRYSFWGEIYETVMAFSLVLPTLLSLVSPKLGKFNVTDKGDLLDKSYMDYLTVRPLIITALLLVMGISWVIIRYLLNDFQGIDPLVIVLNLVWATYSLFIVLASIAVGKETRQIRKNTRIKASLPITLHFDDGAELQTTTEDISMGGVRIAINKIAELRQRTVNSITLMVQRDVVTLPVEMISLENSQLRLAFLPMDLNLRRKLVRVIFGRADAWVHQTQYQDKPLKELGAITGCIFELFFGRRQKVKAPVKRAKTSLSVQSINGDD

SEQ ID NO: 7529 - protein, 89 aa, Proteus mirabilis
ERFFWDAERCSLSCIIIVTFTIICFLYYVSNSNKAVWILIYQCKIRAFSFVLLKNRANRKKNEINTCANLRSPYNAHPLTDDELTTSSH

SEQ ID NO: 7530 - protein, 71 aa, Proteus mirabilis
SLSLALCCSCTLATRNVVNGFINGYLYTVLFITFSPLLSKRFFCPKYNQLFSIFNNLLEWKGISIRNGTLL

SEQ ID NO: 7531 - protein, 65 aa, Proteus mirabilis
YEKFQLLIFFKCKIWLTKQNAMLFFCVDHHQKKTHFYKRKVYFFHRVANTLSCYKKKITLFIQTH

SEQ ID NO: 7532 - protein, 551 aa, Proteus mirabilis
QRKLTMDSQRNLLFIALLFVSFLIWQQWEGDKVSQNTTTTTQVSQQADMPSSDSLAVTGNSNEQAKLITVKTDVLDLRINTQGGTIDEADLLAYPAELNSKTPFRLLETTPQFLYQAQSGLIGPDGPDQKSRPVYSATQQEFILGENQDELRVPMTFVNEEGVKFVKTFILKKGQYDIGIEYKVENPTDKTLTMNFYGQLKQSVKLPEHRDTGSSNFALHTYRGAAYSSDETNYKKYSFGDIEDKNLSITTNNGWIAMLQQYFATAWIPAKDSQNNNFYSITLDNKSIALIGYKSAPITVAPNSTQDITSTLWVGPEIQSEMSAIAPHLDLSVDYGWLWFISQPLFKLLKFLHSFIGNWGFSIIMITFIVRGIMYPLTKAQYTSMAKMRLLQPKLAALRERIGDDKQRMSQEMMALYKQEKVNPLGGCLPLIIQMPIFLALYYMLMGSVELRHAPFILWIQDLSAQDPYYILPLLMGVTMFIIQKLSPTAVTDPMQQKIMTFMPVVFTVFFLWFPSGLVLYYIVSNLVTIIQQQLIYRGLEKRGLHSRDKK

SEQ ID NO: 7533 - protein, 469 aa, Proteus mirabilis
VYELRRGFKMATGKIVQVIGAVVDAEFPQDSVPKVYDALEVMNGKEKLVLEVQQQLGGGIVRCIAMGTSDGLSRGLKVEDLGHPIEVPVGKATLGRIMNVLGTPIDMKGEIETEERWSIHREAPTYEELSNSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEEDKLVVARARKIQRFLSQPFFVAEVFTGSPGKFVSLKDTIRGFKGILNGDYDHLPEQAFYMVGTIEEAVEKAKKL

SEQ ID NO: 7534 - protein, 67 aa, Proteus mirabilis; identical to SEQ ID NO: 5213

SEQ ID NO: 7535 - protein, 70 aa, Proteus mirabilis
CKVRRAPALVRRHYAVLATVSSSYPPLSGRSPYITHPSAARQQESKLSPVTARLACVRPAASVQSEPGSN

SEQ ID NO: 7536 - protein, 81 aa, Proteus mirabilis; identical to SEQ ID NO: 7359

SEQ ID NO: 7537 - protein, 89 aa, Proteus mirabilis; identical to SEQ ID NO: 6273

SEQ ID NO: 7538 - protein, 115 aa, Proteus mirabilis; identical to SEQ ID NO: 7368

SEQ ID NO: 7539 - protein, 620 aa, Proteus mirabilis
WIISMRLKSINAFVLSLLVSPFYVCADLNMDFLHGGVQLQAAGVFDENTNYPAGHYIVEVIFNRKLISKKELIISPEDNENLCLKKDWINELSLPIKLNLFELYYHPERDCYDISRYPGAQVIFDNSKQTLTFSIPQIALDESLRRQEWDYGITGIKLNYSGYISKTSSSQAQIYGDFDLYANLGRWVAYVRSSYQRNSGTETSEATVSTAIKSIQGSFTVGKTITSLSILPNFAFYGMSLRSERDMRPWEKRGYAPVISGVANSNAKITISQNGYVLSSQVVPAGAYQLKNIAPVSNGNITVTVEESDGTKTVRYYPVATLSSLLRTDEINYNIAIGEKETVGKRENSLFFLGAFDYGLTNVTVHAAGILHNNYKSAALGMSKDFGRFGAMSFTANTAVSVFQKQTPTAPEVRQSGISYSLQYANSLTDNTNLQLLAYRYTGKDYVDFNEFNSNALYHRSNRKERYETILSQSFDGSFVSLSAWMQTYRNSISNEVGANITYNTTIKSVDFSLSADYQKLNDYEHDNYIISVGINIPFSLYDKNHFWANSVSYDRKNKASFNSGVSGSINEKINYSINTSKDRDNWSNSAYFGIDHSIINTGYAISQNGHQTTSSINAS

SEQ ID NO: 7540 - protein, 175 aa, Proteus mirabilis
ILKSIVNNWVDAMRKPTFYSFLLCIILLAGCSSSPSKRLPPAPPLKTQLSDPIMVIVQLKSQLEQWYGTPYRYGGMSPSGIDCSGFVYRTYSDRFDIQLPRMTIDQTKYGTQISKSDLMPGDLVFFKTGGGDNGLHVGIYDTDNTFIHASTSKGVIRSSLDNAYWKKTFWQARRL

SEQ ID NO: 7541 - protein, 102 aa, Proteus mirabilis
GTRPMALTKAEMAENLFEKLGVSKRDAKDLVEAFFEEVRRSLENGEQVKLSGFGNFDLRDKNQRPGRNPKTGEDIPITARRVVTFRPGQKLKSRVENATPKE

SEQ ID NO: 7542 - protein, 181 aa, Proteus mirabilis
MELTMVKKSCFMFSVILFPIYVGATSFTSNVTGGTVTSNLSMTVKASCSTTVGDVTFGDQSAGDIKKGAVAEKVISLAIVCDTKMTNYTLAFTAADGVKDVANGIINTKLNSTVGYQLKWGDSTVKPVDTAITINGSTITPTNKPTQESFTIPIKVKPVALGETVSPGAANTALNIKLTFN

SEQ ID NO: 7543 - protein, 429 aa, Proteus mirabilis
PQNASSFSQCTWKVKAFTTRKKLTLILDYMGSIMTYDVIIIGAGLVGLGVASALQESQPELKVLVIDKESGPAVHQSGHNSNVVHSGIYYTPGSLKARLAKQGNITTYNFCKQHHLYYDRCGKVIVATDEKELPALENIYQRGIQNGLEVIKMTESELKAREPYVNGIAALLVPDAGIVNYPEIAAKHVEIIQARGGVFAFNQAVNAINETDETVTVTTSTTQFTAKWLINCAGLFSDRVAKMAGYDTGMKIVPFRGEYFMLNSNKNYLVNHLIYPVPNPDFPFLGVHFTRMYNGHRDLGPNAVLAFKREGYKKSDIDLKDLTEVLTYKGFWKIAGNYLGEGMAELRRSYSRKLFAQNAQKLIPALREADIHPGPAGVRAQALTREGKLVDDFHFVKGKRSLHVCNAPSPAATASIEIGREIVREHFLL

SEQ ID NO: 7544 - protein, 106 aa, Proteus mirabilis
SLLATPDTGLLFSNVRRDTVAIAKIKNIEGITFNDSPSTDKEGNTIVGVSPYIENNLKINTEEIPNNVELLDSVQNFTPADKAIIYREFKYSTIHRYIFTNKKIKW

SEQ ID NO: 7545 - protein, 69 aa, Proteus mirabilis
QLIYIVLIVPYYKRSICLVANNQIKRGAPKVAVITPIGTSAPFNISLDIKSANISKLAPVKAQPGNKVL

SEQ ID NO: 7546 - protein, 345 aa, Proteus mirabilis
FMGYLLNNMNNQYDDPLNQLRHKQQISDKLKLTLLVLVLFVLIVISLSAGEIWLFPNKWLTEEASLFIWQIRLPRILAVMMVGASLAIAGAIMQAIFENPLAEPGLLGVSSGAGVCVVLLIVFQLGTAYWLISSAAILGALGITCLLMFFSQIKKLSNAQLLLIGVALGVLASAVMTWLVYFSSALDLRQLMYWLMGSFSGIDWRHQILFWALLPIITLLIWQADILNYLSLGSFEAKKLGISVIIWRNWFILTVGLLIGFSVALAGAISFVGLIVPHLLRLSGITHYKTLLPGCALTGASLLIFADLISRLMLNGAEVPIGVITATLGAPLFIWLLATKQMERL

SEQ ID NO: 7547 - protein, 70 aa, Proteus mirabilis
NGDFISAGSAVRNKNDEYIGFVSNSGVLLLNLLDKPNKLFVISPNGEKCTLNLEKVESNDHKIMEIECNE

SEQ ID NO: 7548 - protein, 147 aa, Proteus mirabilis
NRLQITYVTILFNWALCPHLLWEVFMAENVVNDILKWLETQLQRNEGIKIDTIANKSGYSKWHLQRIFKDFKGCTLGEYVRKRHLLEAAKSLQEKDMSILDIALMYGFSSQATFTRIFKKHFNTTPAKFREHGELPDTRRFMSCENS

SEQ ID NO: 7549 - protein, 670 aa, Proteus mirabilis
KTQQKSGRRLMKAIVFAYHDIGCVGLKALEKAGFDIQAVFTHTDDPNENHFFSSVARVSAEMGLTVFAPENVNHPLWIERIREMKPDVIFSFYYRHMLSDEILNLAPKGAFNLHGSLLPKYRGRAPINWAIVNGETETGVTLHKMTAKADAGDIVAQEKVTIEDTDTSLILHEKVREAAAKLMAHTLPHIASGNYSTTAQDESQATYYGRRCADDGLIDWNADAKTVHNLVRAVTEPYPGAFTFLGERKMIIWRARPVADNQGKRPGTVISTEPLVIACAKGAIEVITGQSENGLYVQGSRLATEMGIVTDVRVGPKATAQVKRRQRVLILGVNGFIGNHLTERLLKDGNYDIYGMDIGSSAIERFIGNPRFHFIEGDVSIHTEWIEYHIKKCDVILPLVAIATPIEYTRNPLRVFELDFEENLKIVRYCVKYNKRIIFPSTSEVYGMCDDKEFDEDNSRLIVGPINKQRWIYSVSKQLLDRVIWAYGAKEGLKFTLFRPFNWMGPRLDNLNSARIGSSRAITQLILNLVEGSPIKLVDGGEQKRCFTDINDGIEALFRIIENRDNKCDGQIINIGNPTNEASIRELAEMLLDCFEKHELRGHFPPFAGFKKIESSSYYGKGYQDVEHRKPSIKNAERLLDWKPTIETRQTVEETLDFFLRGAVEELGNK

SEQ ID NO: 7550 - protein, 656 aa, Proteus mirabilis
VMTNNDHLTPVEPPALDKEASSGTRHLTGIYLKITTTLAIFISLYAIYSNALSNTQEFYRNTIFLSGILILGFILFPFSKRFSTAKFNGWDYLFIALTLISYGYFFFNYVDLHVVRKSIPNTMDYAMAILGIIVLFEAARRTTGYFIPSLATFAIIYALFGQYFMGIFGHAGFSVERLLYRLFMTSEGIFGITLSTASTAIVVFILFGSFLSVSGATALFNDLALAMAGRRRGGPAQVAVISSALTGSLSGSAVANVATTGTFTIPLMKNIGLTSRFAGAVEATASTGGMIMPPIMGAAAFIMAGFLGISYTTIVIAAIIPALLYYAALIMAIDIEAKKQGLKGLSKENIPQVKAVLKARGLLLLPLIIVIGTLLMGKTPIYAGFLGILTIIVASWLTPDKTVRMTLTKVADALAEAARGSVQVTIACAAIGVIICVVTMTGIGATLAFNIVSMTDNTLWMILLVVMLVCIVLSMGLPSTALYIVVAVTVSPILIKAGVMPLAAHFFVFWFGALSNITPPVALASYTAASIARADPMQTSWDAVRLALPGFIIPFILVYNPALLMQGDNLSVISIGLMVISALVGIYALSIATANFWIIKTTWFERIAFAAAAILMIKPGLYTDLLGMALILLTGAFHLLRSKKQLVNVGQVSGEN

SEQ ID NO: 7551 - protein, 73 aa, Proteus mirabilis
EIPKKPAIIKAAAPIIGGMIIPPVDAVASTAPAKRDVKPIFFINGMVKVPVVATLATALPLNEPVNADEMTAT

SEQ ID NO: 7552 - protein, 562 aa, Proteus mirabilis
GANKRSNKTMLNNRASKIGAILLALFFVLTYLFPLNSRLLWQPDETRYAEISREMVVSGNWIVPHMLDIRYFEKPIAGYWINNISQLIFGHTNFAVRFGSVISILLSALLIYLLARMMWRNRQVAFVASLIYLSMFLVFSVGTYSVLDPMLALWVTASMVCCFWALKATTAKTRILAWITLGLACGMAFMTKGFLALAIPVIVMIPVTLYQKQFTRMLLYGVLAVLSAALISLPWVLAVAKAEPDYWHYFFWVEHIQRFSGDDAQHSSPFWYYIPIILLGVIPWLGLLPGALTSAWKKRRKRPELFFLLCWFVVPFLFFSIAKGKLPTYMLPFMGPLAMLMAKYGVDCARKFKMKALRINGYINIFIGVAAVVAILIIQLVSSKPIYMPYEWSKWVLAIVAFSLWGIIGYLCSTLNGKHWLWAASCSLGVSLCIGQAIPNSSIDGKLPQEFIRQNIDTLNASKYIVSNSVGVGAGLAWELQRSDIYLYERTGELTYGIEYPDSQHRLLKPESFEQWLENARKEGNVSVVITYKDPKKLAQMPRPEELVTNRRMAILTYEKRK

SEQ ID NO: 7553 - protein, 237 aa, Proteus mirabilis
MIKKISRQKASQQILDQIKQNIYDGTYPIGEKLPSENVLADAFGVSRVPIREALGVLEASGIITSRQGGGRRVIDHSILSKYEPIVMEIACPQEIESLLEMREVIEHEAAAIAALRRTPEELLTIEQAHQAFILATQKNNNIGHQEDYQFHRAIMVASHNPFFVRILDNLHELYLGVLMYSLSQNKGRIAETERVIAEHEAIVEAIRQQDSDETSHKMRLHLANVRGKLKRLQQEKN

SEQ ID NO: 7554 - protein, 112 aa, Proteus mirabilis
LTMNAGRRPALVKQAKGYYGARSRVYRVAFQAVIKAGQYAYRDRRQKKRQFRQLWIARINAAARQNGMSYSRFINGLRKASIEIDRKILADIAVFDKAAFAALVEKAKGALA

SEQ ID NO: 7555 - protein, 298 aa, Proteus mirabilis
VMKKVGLRVDVDTYRGTKEGIPQLLDVFNKHNIQASFFFSVGPDNMGRHLWRLLKPKFLWKMLRSNAASLYGLDILLAGTAWPGKKIAKNLGYLMKQTQDAGHEVGLHSWDHQGWQAKVGRWSTEELMQQVRLGVEALEKALEKPVKCSAVAGWRADERVLMVKEAFQFDYNSDCRGTHPFRPVLENGSIGTVQIPVTLPTYDEVVGTKVKDEDFNQFIIDEIKKDQGIPVYTIHTEVEGMSKAAQFEQLLAMIANEGIEFCPLSHLLPQDIDMLPMGKVVRSDFPGREGWLGCQQEV

SEQ ID NO: 7556 - protein, 186 aa, Proteus mirabilis
NISDMSFCMNKKIYMYFIITCLSNFPQPSLSDEILPDAQLTISLDVVRITCDINNGKGFNKIVDFDVINESNLLAGNQPAVKTQFIVDCQKSGFKPEHIDIKVKPGSQGALNNGIGGELKTNLSGVGIYLSWADSSPINLSGVNKSFSADLNNQFDISFFAKPYAQSQIVEKGSLKSSIIINALYK

SEQ ID NO: 7557 - protein, 143 aa, Proteus mirabilis
MNNESRCIFSEGSVLLPDGYKEQTINILISPTGHAVNISRDDKAKDLSFEEYILNQKALLQRSLKEWQLLEENPSMLGQDLIQGYLISSRYRPNKKQQVYQIQAVYPLTDTQVLIFTMSSPHAFNDTQWTWMNTLLSSFQPRG

SEQ ID NO: 7558 - protein, 340 aa, Proteus mirabilis
QLIDLIRSKEEETMPHLAELVAQAKAAIEKAQDVAALDSVRVEYLGKKGHLTLQMSTLRDLPAEERPAAGAVINQAKQEVQQALNARKEQMESALLNERLAAEKIDVSLPGRRIENGGLHPVTRTIERIETFFGELGFSVESGPEIEDDYHNFDALNIPAHHPARADHDTFWFDAKRLLRTQTSGVQIRTMQNKQPPIRIIAPGRVYRNDYDQTHTPMFHQVEGLIVDKDISFTNLKGTLHDFLKNFFEEDMEIRFRPSYFPFTEPSAEVDVMGKNGKWLEVLGCGMVHPNVLRNVGIDPEVYSGFAFGMGMERLTMLRYGVTDLRSFFENDLRFLKQFK

SEQ ID NO: 7559 - protein, 94 aa, Proteus mirabilis
YPTELLSLTLMIPVVALFTPSLPEKLSVYAGNTALHVKEIFIFFPAIVFIFTSLAVCSPNATSLTDTAQEALFINVIDVGALRATLSFCNVLPI

SEQ ID NO: 7560 - protein, 1439 aa, Proteus mirabilis
YTMDMDEHLAIEFSTKGIITMLEAARVGDIIGHSKSMWGMLVGTLLGAAIAIGGAMISGVLMGAGIAASCIGIGVLAIGASIAVGYGTTLLADWVRDKCVETGSKSLSPCGEILDGSKNVRINGKPAAMSTRSNVKCDKENSERQIAQGSGSVYINGFPASRVGDKTTCDATIMEGSPNVRIGGGTQATEDIEPEIPSWVTTASDLTMLFAGFLSFGSAAAKGPGAVAKLWNKLPGSAKISRFACRYGKIFTGLSLAIPAIGILTRPVEVIGGQKILNDEDELDFSYEAELPLYWQRNYLSSYCYEGALGRGWSFFWESQLIKSEDGFVWQNLSGDILPFPDIPLGHRNFNEAAQGWIIHHEDDSWTFQDAGELRYHYPPFDDKGYSRLSHIVDNVGNEQRFHYNEHHQLIHITGCGDLNIECEYQSFQLAEKTVSRLTAVYQVNPHQIRRRLCAYFYNESAQLIRVEQQTNHPYRQFGWTDAGVMAWHSDKYGLRSEYRWALSEDNLWRVIENKTSEGESYRLEYDDINLTRTAYWHDGSTSFWQLNHDHQIIHYIDRTGIKTALIWDEFGLPCGCRNALGHTHISEWDALGRLLSITDGNGNQTRWQYQNERERLITVFWPDNTESRLAYDSLGRLIKEISPLHQITEYRYDFKTTLRPTIRIDAKQGRSEFLWNKRGQLLRHTDCSGKQHIWCYDDEGRVVSQTNALQEATEYQYDEVGHLARIILPDNSTVQLAWNAAGLLTHHQRNDNTPCQWQYNAFGRVTTEIDKLARHIHYHYNAQGALISIENANGGRYLLNRDAEDRLVEEIRPDETLLQYTYNVAGRLVEEAHLGDRVFTSAPRTILLDYDAAGNLVKRETLTDRYQYQWDSMNRLLVASKQPNQRGLEMGLQANQVHFTYDALGRIIREQTGDDIVEFNYDELNNLSRLTLPQGDSLNWLYYGSGHATAINHLVDSRSQLITEFERDDLHREISRTQGELTQYRQYDKLGRTISTFSSRDKQHPLNGITLWRKWFYDPQGNLGAMEDTYRGWVEYLYDSEQRLKKVASSENLDAMLFYDRADNLLERPQSEMDAEHSPTLELSPQGDKLRQFQGWHYQYDAYGNVIARRYRNQSSQTYAYDGDNRLVIAHNQGIKAQYHYDALGRRIHKTVENRESGQVKRQETHFIWQGLRLLQEQDINTGKHQTYCYEEHGSYTPLAVIVKQSSGFHYYWHHCDINSAPLEVTNAQGNTIWSGKYERFGFVRSSPLSFYSSPERVMASFEQNLRYAGQYFDNETGLHFNTFRFYDPQIGRFIMPDPIGLLGGINLYQYAPNPLGWIDPWGLSSQEMVRVRHHTSVEGLEGIKNTQSINPARGTPIGVHIEIAPFGDPKTAGADIGSWKSGSYVEYEVPKEMIVETNVGPRKTGVIPNEQPPSLHNKNTVFKNQSWWSRLTEKGCR

SEQ ID NO: 7561 - protein, 801 aa, Proteus mirabilis
IRWDYLMKFSELWLREWVNPAISSEELSEQLTMAGLEVDGVEPVAGDFNGVVVGEVVECGQHPNADKLRVTKVNVGGERLLDIVCGAPNCRQGLKVAVATVGAVLPGNFKIKAAKLRGEPSEGMLCSFSELAISENHEGIIELPADAPIGTDIREYLKLNDNAIEISITPNRADCLGIMGVARDIAVINKMTCQIPDMSPIAATSSATFPVRVEAPQACPRYLGRVFTNVNVKANTPLWMQEKLRRGGIRSIDPIVDITNFVLLEMGQPLHAFDLDHVDGAVVVRMGKEGEKLTLLDGNEITLKDDVLVIADEKQALGMAGIFGGESSGVNEETKNVFLECAFFSPLAITGRARRYGLHTDASHRFERGVDSELQYQAIERATKLLLEICGGEVGEIIDVTNDSYLPHVAPIKLTRAKLDRLLGHVIDDEQVVDSLTRLGFGVTVENDGWLATVPSWRFDVEIEEDLIEEVARIYGYNNIPDVPLRADLIMTDHREADLPLKRVKTMLVDNGFQEAITYSFVDPKIQSLLHPNEEALILPNPISADMSAMRLSLLTGLLTTVVYNQNRQQARVRLFEAGLRFVPDNQAEYGIRQELMLAGVIAGNRYEEHWTLEKQTVDFFDLKGNIESILELTGQLDEITFKPANHSALHPGQSAEIYLRNEYIGCIGVVHPELERKLDLNGRTVVFEIRWDAIANRNLPQAKAVSRFPSNRRDIAVVVPNDVAAEDILAECKKVGGNQIVGINLFDVYCGKGVAEGYKSLAISLILQDIEHTLEEDEIAATVNTCVAALKQRFQASLRD

SEQ ID NO: 7562 - protein, 575 aa, Proteus mirabilis
RSFCFYSFTCKLKEGFMNSHHWNCGADLVVKQLEQHGVKQVFGIPGAKIDRVFDSLVDSTIKTIVVRHEANAAFMAGAVGRLTGKAGVAIATSGPGCSNLATGIATATSEGDPLVALGGSVKSTDRLKLVHQSMDTVTMFNPITKFCAEVDSSQSISETLANAFRHAESGRPGSAFLTFPMDILNNEVDSPLLTPKSKPNLGAASDSAIQEAISLLLQAKNPVILIGLQASDPENALALQNFLDIFPVPIVGTYQSAGAIAHRHFPLFAGRIGLFNNQPGDELLAHADLVITLGYSPIEYEPSLWNSHNANIIHIDEIQAEIDLAYCPALELTGNIKLTLDKLTQQLTHQPNSKLQLSNQSQGILEKIRQQREILQQNSYFRQGTPIHPLTIIHEMQDIIDNDVTLCIDMGSFHIWLARYLYSFRARQMLISNGQQTMGVALPWGIGASFVRPCDKIISVSGDGGFMQSSMELETAVRLNTNILHIIWVDNAYNMVEMQEEVKYGRPSGVKFGPIDFKRYAESFGAKGFSVECASQLRETLRKAIAVDGPAVLAIPVDYRDNDKLMKHINYNLII

SEQ ID NO: 7563 - protein, 284 aa, Proteus mirabilis
IRICFIMKTSFNHIERDNSDITHNHKNTHSSCNCTQEIITSLNHYINKHPECTIYQNSLMSSLIAGVYDSNVTIADLLKHGDFGLGTFNHLDGELVAFDSNVFQLRSDGSAREARPDQGSPFAVMTFFKPDITHQFSDPVSQQQVHNIINQYVPSDNLFCAIKIEGEFELVKTRTVPRQEPPYVPMLEAIENQPIFTFHDEMGIIAGFRSPQFTQGLNVAGFHEHYINHQREGGGHVLDYQLKKGTLQIGVISRFTIDLPHQSTFLEANLMPDDLHQAIEQAEN

SEQ ID NO: 7564 - protein, 124 aa, Proteus mirabilis
GTMCKSILLTSLLIFITRSCYGSELNATSIIGGAVQSQFSMNVKIATCLPATVDNVTFGAVDTATILSGEVEGHSTLFLDCTGTIKPQRVTILFEPANPHLTMGSVGYIGSKNTTLGYFVSWEK

SEQ ID NO: 7565 - protein, 331 aa, Proteus mirabilis
PLKLLMIMVLDVLLSLIKEVKMKNKSFYFTLLLFFIAMDTSAARCRNVSIKYNFPAQIDITNKKVGDKLYSFGAPDAPINVAGQCLRANSGAGNTNGNYIYIVDQYGSSPTLCPTTGTVDKNSPDGYLRFRSTGSCANSSWLLVLDYKISGVGWTNLTGPGGGTDSGVVYLQKKPPVGKTVINPVYMLKRNYYSRIGQMGNTLQKESVALSAPTSMTLINNASCAVSVNDVAFGEQTASDVKMNTIAGKNINISFTCNAVLPAYTLSFSGKDGVNNATTGIIKVKDNSSVGYQLSWADSTVKPINSAVVINNVAIAPESRGENPNNFTYFR

SEQ ID NO: 7566 - protein, 258 aa, Proteus mirabilis
PLNRWSAYNMAQLKLYKLAVNKRLYGITEQVNDGERIHLIGANGAGKSTLLMAIAGEVSYVGNIFLNETSMRDYKIAELSRIQSVVRQQSLALPFMPVFHYLSLSYQLSKMDIQELNALLSDFQINKLLSKNIHHLSGGEWQRVRIVATFIQLWSSDDLTGKLMMLDEPTNNLDIVQLTLLDKWLDKFCLQGGSIIMSTHDLNHSYLKADKLWFMLEGKIINSGDSALLLDENLLSTTFNTKIRCNRSANSVIWQVIE

SEQ ID NO: 7567 - protein, 83 aa, Proteus mirabilis
TESSNSTLFGISSVFIFKLFSMYGDTPTIVFPSLSVDGESLNVIPSIFLIFAIATVSLLTLLNNNPVSGVANKLHEALIELVV

SEQ ID NO: 7568 - protein, 333 aa, Proteus mirabilis
NSFGAYLVSTFEKINKVSVVIPVYNEEESLPQLLERTIKSCKQLEQEYELILVDDGSSDNSAKMLEEAANIEDNHVIAIILNRNYGQHSAIMAGFNQADGDLVITLDADLQNPPEEIPRLVATAEEGYDVVGTRRRNRQDSWFRKTASKMINAMITKATGRSMGDYGCMLRAYRRHIIDAMLQCHERSTFIPILANTFARRTIEIEVAHAEREYGDSKYSFLKLINLMYDLLTCLTTAPLRLLSVVGSVIAVAGFLLAVLLIVLRLIFGAIWAADGVFTLFAILFMFIGAQFVAMGLLGEYIGRIYNDVRARPRYFIQKVVGVKKPNKNQEED

SEQ ID NO: 7569 - protein, 342 aa, Proteus mirabilis
GYLMSGKLRLLLSESYDPWFNLAVEECIFKQMPADQRVLFLWRNDNTVVIGRAQNPWKECNTRKMEEDGVKLARRSSGGGAVFHDLGNTCFTFMAGKPEYNKTISTQIILDGLSKAGIQATASGRNDLVVPLADGERKISGSAYKETKDRGFHHGTLLINADLSRLANYLNPDPKKLQAKGITSVRSRVTNLVELKPDITHEKLCHAITDSFFDYYGERVEAEIISPQKLPDLPGFAETFAKQSSWEWNFGQAPAFSHLLDNRFKWGGVELHFDIERGTIIRSQIYTDSLDPAPLEKLSQMLVGQRYASSSMKRLLAQLIEQYPNNQSELEELQQWLVHALS

SEQ ID NO: 7570 - protein, 121 aa, Proteus mirabilis
KFIIIVNIHYRQPFSVKRDHQDWFLNTVFLLCRDGGCSFGMTPVFLGPTLVSTIISFGTSYSTYEPLFQDPMSAPAVLGSPNGAISICTPIGVPLAGLIDCVFFIPSRPSTEVWCLTLTIS

SEQ ID NO: 7571 - protein, 174 aa, Proteus mirabilis
KPILVVSFNRKRLSIMNIYYDNKLLLALYSYLRQTELSIDRGLNEWKNARSYLKHRYLADKLIMALAINKTLHQKNTFSKVYCYAYLKLRHKQYLTRQESDTICCLLRTIGSYLSEDSPDRSNLIKLRIELYNAAKLVRKRITNNNRIILADRVEHYNQHLHGTFYSIEEITSL

SEQ ID NO: 7572 - protein, 386 aa, Proteus mirabilis
LGYIFMSHFLPFSRPAIGDEEIKAVESVLRSGWITTGPQNHQLEQDFCEKFGSKHAIAVCSATAGMHVVLMAMGIGPSDEVITPSQTWVSTINIITLLGAEPVMVDIDRDTLMVSAESVKKAITPRTKAIIPVHYAGAPCDLDALRAVADEAGIPLIEDAAHAIGTRYKDEWIGEKGTSIFSFHAIKNVTCAEGGLVVTDDDELANRVRCLKFHGLGVDAFDRQVQGRKPQAEVVEPGYKYNLSDIHAAIAVVQLSRLEEMNAKRAELVALYREKLQDSPLEMLSVPEYPHLHANHLFMVRVDKNACGIDRDTFMEKLKQKEIGTGLHFRAAHTQKYYRERYPSLSLPQSEWNSATLCSLPLFPDMSNKDVIRVVDAINEILSEHI

SEQ ID NO: 7573 - protein, 180 aa, Proteus mirabilis
RGKILSKENKMEILHSMLDTLSHVSPIALFFTITLLTAGKSTIGISSFLPPASLMLILIFGVCLPFHSPILLWLATSLGALLGSIVSYQLGRSIYYFPRLNKWVTRYQTKILRIQQLLKNKAFFILFISRFLAVFRYLTPFSAGLLKLPIYGIYLTSTVSALVWSGVFILIANGVISISL

SEQ ID NO: 7574 - protein, 94 aa, Proteus mirabilis
EKGMLSQMKKDDNNSVSMSDFFNKKTGLFIKYKRKELGLTGQDLAIILNVSQQQISRYENGTTNITVTLLNKILMILDSSWSEFLTFNELTDRY

SEQ ID NO: 7575 - protein, 234 aa, Proteus mirabilis
NLMIIKLWKLNVMNRIVFVFALIISSLTCFKAYSAFTLNGTRFIYDEGRKNIAIEVKNNSDKTYGGQVWIDNLNGNEVFFIPAPNLFKITGGEKQLIRLLYVNDILPKDRESLFWLNIQEIPPISSADDSNVLAVALNTQVKLIYRPKILAEKREDAEKSLTYSGSVLKNPTPYYFALTQVSVNNNPLVLSKDIEQSISLFPPFSEVNVQRPLLGKVTVEAIDDYGARRVIELN

SEQ ID NO: 7576 - protein, 114 aa, Proteus mirabilis
VMAFFLLLIVSLLTCIGQVCQKQAVVSWQNNSTTKARKTIFWLITAIAMLGFGMLFWLRLLQILPLSIAYPMLSINFIVVTLIGQFIYKETVNVKHWVGIASIMLGIVLMSMQS

SEQ ID NO: 7577 - protein, 83 aa, Proteus mirabilis
PWVVWVILVQKIPHLAILCRGKNEQIGAIGEGVPMGKALFFKKTDASLMKVKLKIKPVVLPLGGKSVHLGNGNTHITIKIKYI

SEQ ID NO: 7578 - protein, 358 aa, Proteus mirabilis
CEIFTCVFMYRNNIMRIRKTKLAIGIVAVIAVVSLAMIGKKENANKQFLSVATASTGGTYYPMGVGLANVWSTHLKDRGIQVTGQSSAGSIENIYLMQQNEAQLSILQSLLAVEAYEGVRNFEGKPEKNLRSISMLWPNVEHFVLMNDKVKTGTLDDIRATSFSVGPQASGTEQSTIIILKGVNLTKKEITPEYLGYGDTVSAMRDGRLDGGALPAGVPASAVTDMYASGVNAKLLEVTDKQLDDINHIANSWFRFEIPANTYPRQAEKVNTIAQPNILMTTTSIDDQLVYELTKTMFENLPEVHQVHSAAKYITTENALKGVSVPLHLGAYRYYKEIGLDIPDYLIPPEAQTQTNNK

SEQ ID NO: 7579 - protein, 154 aa, Proteus mirabilis
CETLGWYCLDYVRYCVNEYAVMKTGYLWAIASALLVTVAQLLLKIGMSELPDLQLEKQWFDLHWLWANIIPISVVFVGLIGYVLSMVCWLLTLRTIPLNKAYPLISLSYVFVYILAVVLPWFQETLSWSKTIGIIFIMLGVWLISQKTEQTTSH

SEQ ID NO: 7580 - protein, 172 aa, Proteus mirabilis
MKKLLLPLVMSSALFSGYTLANTGEVQFIGAVTSETCDIDTEIGGLVKSTIDLGKMTTADTNGKYVEFELVPRTDECLKKTSGQVGWQSAGFTNSGLANMKGTAGGVSIQLTAINSTTPNQDVTYNNQSVDFGNGNDPIGNMKFKARMTATAGQTVTEGTVISSATYAVAYK

SEQ ID NO: 7581 - protein, 160 aa, Proteus mirabilis
LVFSNCSRRSDFTYRRILCLNGQANYMDFIRTNQRKVFFLFFLNEILKINYLYEYNSYNNEESLFFINDKNMLLHHEDICYNLDIDNKGYFCIEAKIVNLHGIAKLFEFKSESNFGPYDINIQLDDIFYYVLVLPDFIENSQFCSDIHSLFVNNLERIRL

SEQ ID NO: 7582 - protein, 72 aa, Proteus mirabilis
SLDSTFSKFKVHFSPLGDITNSLLGLSNKFNKRTPEFETNPIYSSFLFLTALPAEIKSPFYFFIRKYIPVNC

SEQ ID NO: 7583 - protein, 195 aa, Proteus mirabilis
IFSSCDTHCGVYVMKNSIIKSAITCLLLLSPSTFAATDIIGGEMEFKGVVVAHGCTIVAGDENKVIDFKQISAKDLYSLQKSNPVAFSISLENCSQDIYKSVTITLDGQAHSTMPNHIAVTGSGSEDPKSIGIAFTDKAHNIIELKKPSAPQQLNNKRVQFDFMAYVEATSSAIQNQTILTGPFQAQATYTLNYQ

SEQ ID NO: 7584 - protein, 62 aa, Proteus mirabilis
RKRSMFQTHTRHPFFLFFVTNPYLCAILTLAYTYPLIITIEPICVQVCTKILDPLVFYQWDF

SEQ ID NO: 7585 - protein, 116 aa, Proteus mirabilis
QDNPMKKIEAIIKPFKLDDVREALAEVGITGMTVTEVKGFGRQKGHTELYRGAEYMVDFLPKVKIEIVVADEIAETCVDTIMTTAQTGKIGDGKIFVFDVNRVIRIRTGEQDEEAI

SEQ ID NO: 7586 - protein, 115 aa, Proteus mirabilis
SICPAFESPTTHHSQYYLKFLRKILNGSIAQSVKQLLLINFPAVESPQTHLYYLTGGLLIGKTFSLKEEVDVSNPYPPPIFFIFRDKPLFMRYPYLSLYLSLNNNHRAYLCSGVY

SEQ ID NO: 7587 - protein, 244 aa, Proteus mirabilis
KSMLENIRIILVETSHTGNMGSTARAMKTMGLTNLYFVNPKEKPDSHSIALSAGASDVIGNAHIVDTIDDAIEGCGLVVGTSARNRTLSWPMLAPRECGERCVKEAANKPVAVIFGRERTGLTNEELQKCDYHLYIPTNPEYGSLNLAMAVQLVCYEIRMAALAQQEKQEENASSEIDYPPAEDIERFYVHLEQVLNESGFIRPKHPGQVMSRLRRLFTRARPETQELHILRGILTSVEKWAKK

SEQ ID NO: 7588 - protein, 148 aa, Proteus mirabilis
TKYPNSDMPLEFDFVPTLEVEMITGIQITKADNDDLLHSFWLLDDENGEARCICAKKGFEEGQVVSRDALGNIEYREVPVESKPVVRVEGGQHLNVNVLSRETLEDAVNNPEKYPQLTIRVSGYAVRFNSLTPEQQRDVITRTFTESL

SEQ ID NO: 7589 - protein, 68 aa, Proteus mirabilis
PSNPPFLTCKKTRQEHVLEAGLYNGFYYIVTNLCVNWKFSADIQDFLFHFFNVRFIIDIIKDITHPTG

SEQ ID NO: 7590 - protein, 498 aa, Proteus mirabilis
KTTLTRTNLLNNIRINYFVIVIIALFSAAIIALNITWPDRQKAQINKILSRGELRVSTIPSPLITINDKKDPVGFDYELVKRFADYLGVKLVVNMRTNINQLFDDLENNKADFIAAGLIYNKERLDTTRSGPAYFSVSQQLIYRKGTLRPRRFDELNGRLVVAAGSAHASLLKTLKETQYPELEWEESETKTTSQLLEELSEGKITYVLADSISVAVQQRIHPNVAVAFEVTESRPLTWYLPNQDDNSLYAAMLDYFNQLSQDDVLARLEEKYFGHVGSFDYFDTLSFITAIDSILPNYQPLFEKYAETFDWRLLAAMAWQESHWDPHATSPTGVRGLMMLTRPTASSMGITDRLDPEESIKGGAQYLKHLLSRLPDTIPDDEKIWFALAAYNMGYGHMLDARKLAEQQGANPNSWLDVKARLPLISQKKYYLDLPYGYARGHEAYRYVENIRRYQLSLEGYLQAKESKNKILSKDEKDDSANTALLPPRSVGTPSSS

SEQ ID NO: 7591 - protein, 491 aa, Proteus mirabilis
HRITLIGVEMISLKKWRIFPRSLRQLVIMAFWMVLLPLLVLAYQAYQSLDQLSNQAAITNKNALADTERSEVMRNLAIEMEGNYRRYCVLRDKTDEEMYQQRYQQYSKMFSTLQQTIIPLSESKEAQALNTSLKTLKSIQCKNSEPTSQMQQALEQFSYANNRIVVLTKEIIFSRGEQLQMAIAEKGRYFGWQSLIVFVFSLILIALFTRMIIGPVKGIEKMINRLGEGRTLNNNLNSFQGPRELRSLAQRIIWLSERLAWLESQRHEFLRHISHELKTPLASMREGTELLADEVAGPLTLDQKEVVAILDNSSKQLQLLIEQLLDYNRKLSEVPQQIEEVDLTTLVNDVVLAHSLPARAKGIKTIISLDLKKCRAETTLLSRVIDNLYSNAVHYGAESGNIWISSYQIEQKIVIDIANKGTPIPESEQKMIFEPFFQGSLLRKGAVKGSGLGLSIAHDCIKRMDGELNIVHSDYADVCFRIELPLLSENK

SEQ ID NO: 7592 - protein, 480 aa, Proteus mirabilis
VKRTKAISMSKIKTRFAPSPTGYLHVGGARTALYSWLFSRHNKGEFVLRIEDTDLERSTQPAIDAIMDGMNWLNLNWDEGPYYQTKRFDRYNQVIDQMLAAGTAYRCYCSKERLEKLREDQMAKGEKPRYDGCCRHGDHNHTPDEPHVVRFLNPQEGSVIFDDKIRGPIEFSNQELDDLIIRRTDGSPTYNFCVVIDDWDMEITHVIRGEDHINNTPRQINILKALGAPVPEYAHVSMILGDDGKKLSKRYNAVSVMQYRDDGYLPEALLNYLVRLGWSHGDQEIFSIDEMIKEFTLEAISKSASAFNTDKLLWLNHHYINTLPAEQVAVHLDWHIKQQNIDTSNGPSLVELIKLLGERCKTLKEMAESCHYFYVDFDSFEETAAKKHLRPVARQPLEVVRDKLSAITDWTAENVHKAIQETAEELEVGMGKVGMPLRVAVTGAGQSPALDVTVHAIGKARSIARINKALDFITDRENQA

SEQ ID NO: 7593 - protein, 156 aa, Proteus mirabilis
YDRTQCCRTGITMPQISRSALVPFSAEQMFKLVNDVLTYPDFLPGCVGSKLIKSTPEEMIASVQVSKAGISKTFTTHNFLKTNERVDMRLVDGPFRKLTGGWVFTALDDNACKVEFQLDFEFTNKLIELAFGRIFKDLTNNMVQAFTQRAKEIYRD

SEQ ID NO: 7594 - protein, 115 aa, Proteus mirabilis
SGRLAQLVEHLPYKEEVVGSSPIPPTTSSGYFTQYHTVRYGSLAQSVEQLTFNQLVGRSSRPRPTIPKYTTKSSEHCDGSLAQSVEQLTFNQFVRRSSRPRPTIHNTTLSFYVKY

SEQ ID NO: 7595 - protein, 95 aa, Proteus mirabilis
ITVTYILHLYVTFSLLVVFLLQIDSVTTNNRALPHKINTQLYTKECEIIIYVKDSKYIDVAEGNIFYNISHANIFSYQSKTGYNTALYNNEEMFL

SEQ ID NO: 7596 - protein, 138 aa, Proteus mirabilis
RNETPNERSASLMAIVGIGMDIVEISRIEEIIGRSGERLARRILTDNEWIIYQSHKQPVRFLAKRFAVKEAAAKALGTGIRLGLAFNHFEVANDELGKPTLHFLAVAKEMAQKAGINAIHVTLADEQRYACATVILEK

SEQ ID NO: 7597 - protein, 176 aa, Proteus mirabilis
HNLTIVHHGVFVMRLTSKGRYAVTAMLDVALHSQQGPVPLADISERQGISLSYLEQLFSRLRKNELVASVRGPGGGYLLGREAGQIFVAQVISAVDESVDATRCQGNKEGCQGGDRCLTHTLWRDLSDRITSFLSSISLEELVNNEEVMDVADRQDNEKRHAINGRLQETIVNMRV

SEQ ID NO: 7598 - protein, 63 aa, Proteus mirabilis
SWVTKTLVNLSSLCNSRSQLRNSVLTLASNAPKGSSSNKICGSTANALAKATRCFCPPESCAG

SEQ ID NO: 7599 - protein, 63 aa, Proteus mirabilis
RPETGKHRNCFLGTKCANLLMLISLHTIEIWQTEARGRTPLASPFLDIAIFNFSFDVTKQTHS

SEQ ID NO: 7600 - protein, 65 aa, Proteus mirabilis
FYCALIVATCFISIKYKNKLNMLVVAVEIERQQQIHLIAYFNGQLLFYRKRSKNTQPTLTNTIFY

SEQ ID NO: 7601 - protein, 111 aa, Proteus mirabilis
VRCAMSISLTEAAANRVRSFLANRGKGEGLRLGVRTSGCSGMAYVLEFADVINDEDTVFEDKGVKVIIDGKSMVYLDGTELDFVKEGLNEGFKFNNPNVANECGCGESFTV

SEQ ID NO: 7602 - protein, 300 aa, Proteus mirabilis
SIYFITNVAKNANACYTSPRFLSPFFNILWKITMHPMLNIAIRAARKAGNLIAKNYENPESVETSQKGSNDFVTNVDREAEQAIIEIIRKSYPKHTIITEESGELLGEDHDIQWVIDPLDGTTNFIKRLPHFSVSIAVRIKGRTEVAVVYDPMRNELFSAVRGQGAQLNGYRLRGSNARDLDGAVLATGFPFKAKQHSAAYMNMLTKLFVPCADFRRTGSAALDLAYVAAGRVDGFFEIGLKPWDFLAGELIAREAGAIVSDFTGNHGYLQTGNIVAGNPRVVRALLAEIRSELTDALKR

SEQ ID NO: 7603 - protein, 715 aa, Proteus mirabilis
DCYFFGVTMDFHHKNNYGLYALEILAQYHNISINPEEIKHKFDINGVGLDLTSWLLAAKSLELKVKAVKKTIERLNFIYLPALVWREDGHHFILTKVNKESNRYLIYDLEQRNPRVLEQAEFEDLYQGNIILITSRSSVIGKLAKFDFTWFIPAVIKYRKIFIETLIVSVFLQLFALITPLFFQVVMDKVLVHRGFSTLNIITIALAVVAIFEITLSGLRTYIFTHSTSRIDVELGAKLFRHLLALPISYFESRRVGDTVARVRELDQIRNFLTGQALTSILDLLFSFIFFAVMWYYSPKLTLVILFSLPCYATWSIFISPILRRRLDDKFARNADNQSFLVESVTAINTIKAMAVSPQMTNIWDKQLAGYVAAGFKVTVLATIGQQGIQLIQKAVMIINLWLGAHLVISGDLSIGQLIAFNMLAGQIVAPVIRLAQLWQDFQQVGISVTRLGDVLNYPTESYQGKLTLPEINGDISFRNIRFRYKPDAPIILNNINLNIKQGEIIGIVGRSGSGKSTLTKLIQRFYIPENGQVLIDGHDLALADPNWLRRQVGVVLQDNVLLNRSIIDNIALADPGMPVEKVIHAAKLAGAHDFISELREGYNTIVGEQGAGLSGGQRQRIAIARALVNNPKILIFDEATSALDYESEHVIMRNMHKICQGRTVIIIAHRLSTVKNADRIIVMEKGQIIEQGKHKELLSDPESLYHYLHQLQSD

SEQ ID NO: 7604 - protein, 404 aa, Proteus mirabilis
TEYFSGAIMLDAQTIATIKSTIPLIAKTGPALTAHFYDRMFSRHPELKDIFTMSHQSSGAQREALFNAICAYATHLEDLPAILPAVEKIAQKHASLNILPEHYPIVGENLLATIDEMFNPGKEVLDAWGAAYQVLADVFINREEQIYQQKEQASGGWRGLRHFKVKHKVKQSEVITSFELEPEDGQAVTPYRAGQYLSIYIRDEKLANQEIRQYSLTQSTNNKTYRIAVKREDKGILSNFLHDHIQEGDILQVAAPGGDFYLDISSTTPVTLISAGVGLTPMLAMLHTLSSHQAQVNWLHAAEHGGVHAFKEEIAQAGKQIEQYQQAVWYRLPRTEDIINKDYQFEGLMDLTKIHEWLSIPNMQFYFCGPLPFMQSVAKQLIALGIESDKLHYECFGPHAVISQ

SEQ ID NO: 7605 - protein, 255 aa, Proteus mirabilis
FDFFETEHFLSMGEIGKLSPIRYQQGFYVMTTPLTWHDVIGAEKEKPYFQQILSQVAQQRQAGKIIYPPQEDVFNAFRFTPFENVNVVILGQDPYHGPNQAHGLSFSVRPGVPAPPSLVNMYKELEQEYPDFKRPNHGYLESWAQQGVLLLNTVLTVEKGQAHSHANYGWEVFTDAVIEQINQRREGVIFLLWGAHAQKKGRFIDTNKHFILKAPHPSPLSAHRGFLGCGHFKQTNNLLAQQGRTLINWQLDPIK

SEQ ID NO: 7606 - protein, 341 aa, Proteus mirabilis
KLYFLVFINVKHPIATVPRLLMNTENKTEEVKLTAGQLLRQAREKAGLTQQTVADRLCLKLTTVCEIEADTISSGIAPTFLRGYMRSYAKLVGVPESAILGLIDQQAPIKQVKVTTTQNYSLGKRHKKREGWLMKLTWVIVIAMIALVGLWWWQGHQADQQELVSMASQDIGQNSPQENTNTIESPLSTLDNNSPSSEGENVQVPASPLVDNQANKVAEPSVTDATPEAEVKTVPLPVSPLTTSTTSRADSAEGNSTPAPIVENQLVLMFDGECWLEIRNAQNKVLFNGIKKAGDRLEFNGEQPYKLKIGAPSVTRLQFNGEAVDLSRFTGKIAKITVPSA

SEQ ID NO: 7607 - protein, 735 aa, Proteus mirabilis
GFMAILTLRNVKSYSADKDVNIDLSKPVTLIYGQNGAGKSTISSFFSGFQQEKYQHCHFASRENFAYFVFNQEYIEQKFHQEIYQPGIFTLNEKNDDVNGKIESNKRRITEINNLLNTLDTEIKNKNDAKSTVIEKYSKVIFKKTINDRQSLDYFLDRAKRVNNFYQKMRETSLGIQKYELVQLTERLELLLNSEGTQYTEIIEPEVYGLSDEMLTLLQSSLTASSDTPFSAIIQQLGNADWVHSGTGYIKDNICPFCQQKFDSQHLLHELTLMFDKSYEDALATLTHSQTVISHELDLLESFHEHLRQHPVVSDDHQVFSIIKSLQQTLRNNLQSLRQKLLQPSQSIQPDVITDIRQHLNQILVTLNSNIRDNNQLAANFSQERARLAADSFAYLREVSDPYLRQCDQELAEIQQQLQAEINQVDLLRDEERALSVETTHLIGQLSVIQPTIDNINYNLTQLGINDFNIICHDESLKLYRLHRQNQPDDSEVFKSLSEGEKTIISLLYFLESCIGHVPDSQTIQPKLIVIDDPISSLSHNYIYEVASMIKHKLILPKIAQHIVILTHNIFFFQEILLSVYKRLAPERTTPKGCALYRIIKGEYSDCIPLSMHDMLNEYQALWQTIRDVRDGRSLPVVLPNTMRNILEYYFSFSCKQEKLDKALNKLAVEYSAGEYDSFYRAINRHSHSDGRNIMATGVINVEMYFRLFQKIFEETKDSDHYNTMMGITVEQTEG

SEQ ID NO: 7608 - protein, 129 aa, Proteus mirabilis
IMAYSDKVIDHYENPRNVGSFDNNDPTVGSGMVGAPACGDVMKLQIKVDDNGVIEDARFKTYGCGSAIASSSLVTEWMKGKTLDEAEAIKNTAIAEELELPPVKIHCSILAEDAIKAAIADYKSKRQGK

SEQ ID NO: 7609 - protein, 1716 aa, Proteus mirabilis
VRYYCSLHKTSYNSGVELKEMDMNRDQFRQYTEKRGYRWCTLAVVLASALALTGCDDNKTEDEQSSTSDNSQPTQVAEQKSTSQQTTTQLGDKTAVTTKTNNQTALTSQEVRNELARRYAGKEVTVLDASELQRDGASTMVVTFSVPLDPDQKFDDVIRLVDTKKGKLEGAWELSDNLMELRFRHLPPSTELNLTIDAQIKGINERKLVEPFSQKFTTEEIYPSVGFTSKGSLLPLEATEGLPISALNVEQVDVNFFRVKDDRLTQFLTQWESRSNINYWESDDFLSQADLVYSGRFELDTEKNTRENVLLPLKSIEALKKEGVYIAVMQQAGKYSYTMPATVFTFSDIGLSVHSYLNTLDIFTQSLKNGAALDNIEIRLLDEKGNLISKTKTDNQGHATLEKSDKARLLLAIRNGQTSMIDLRKPALDLSEFDIGGPQGYSKQFFVFGPRDLYRPGETLIVNGLLRDGDGNPIKEQPVKVDLLKTDGQVSRSFVWQPENGFYQLKLMIPENESTGIRKLRFDLGDGTPRFYQFQVEDFMPERMALEITGKKGILLSGNNAYFDIKGRYLYGAPAADNRLQGQVFLKASREAVSQLPGYEFGAVKDENLSRLLDEFELTLDTDGEGALTVDKDRYAEVKSPINIILQASLLEAGGRPVTRRYQQAVWPATHLAGIRPVFAKKEVYDYRNDKYKSGYSVDENSMAEFEIVYTDQEGKKLPADDLKVRFIYERYDYYWRWSNSNGWESGYNQKDLQMDEQTIKIAKDGTAKVAFPVEWGSYRIEVVDPKTELVSSLRFWAGYSWMDNTGGTGAVRPDQVKLKLDKESYLPGEKVKLNIAAPHPGKGYVLLESSDGPLWWQEIDVPEKGLDVEVPINKEWARHDLYLTSVVVRPGDTSKQATVKRAVGILHLPLQDNNRRIDIALDAPEKIRPNQDLKIRIKAKPVAGQPLPENINVLVSAVDTGVLNITDYKTPDPYEAFFGRKRYSVDQYDVYGQLIEGEGRLANLRFGGDGSEESALSRGGKKPLTDVQIIAQQATPVKLNAQGEGEVSLPIPEFNGEVRLMAQAWTADKFGSQEGKVVVAAPLVTQLSLPRFMAGGDDALLSLDLTNLTDAPQSITLNYTASGLVDLAGVDSKTVSLSKGERTQVQIPITAKHGFGQGEFSLSIYGIKVPNEEIKPYQNTWKIGVRPAYPAETIHYANTLADGESWRLPNEALNQFNRSTLEGELLLTSRPPLQVARYVRELFAYPYGCLEQTVSGLYPSLYSTEKELKQLGIKTQTDMQRKEAIEKGIAHILTMQKSEGGFALWAQGGREEFWLTAYATDFLFRASQQGYEVPTEALKRANDRLLRYLQDKNIVNEEYVVNQDAARFSARAYAALVLANQQKAPLGELRRLYLERNQAGSGLALVQLGVALKLMGDNSRAESLIAEGVTMPRKYNYGLGDYGSTIRDQALIIALLSENNLETQTRDASVITLSDNLTGREWFSTQESNSLYLAGRFFIDMAEKPWEVTINRQVPAMSSDRAVNEALTATQLQEGLELNNQGGTTIYSRMNVVGYPKVAPAPYSNVLKINRSYYDLKGNRVDPNRLQSGEMLVVKLEVSANRDVPDALVVDLLPAGLEIENQNLASSSASLSDSAADLQEFIDDMGQANIKHLEYRDDRFVAAIAVDKYRPTTLLYLARAVTPGSYQVPPPQVESMYVPYWRAVGATKNKIDVVP

SEQ ID NO: 7610 - protein, 224 aa, Proteus mirabilis
YKSYKMAEPSFTEGYFYMQKEKLSAFMDGEVLDKELMGSIARDESMKETWQRYHLVRDAMRGDVGEVIHFDIASRVALALENEPVRISPEQQQEQQPAPSQWRQHSFLQKLRPWASQLTQIGVAACVSLAVIVGVQQYNGNNSAEDFQVDTPVFNTQPIMGNGAPVSLNLQSDNLGQNQQTRLQERNQRLGLMLQQYELDRRIYNAPQDEVPVASQNTTQQQAQ

SEQ ID NO: 7611 - protein, 198 aa, Proteus mirabilis
MSILEWPKEVIPTQENWQLLSNSKTFTSPFNGSSQTVRFPGSRWRCELTFNNLNEEKSRQLEALVASLDGMSGRVKIASWIRKGRYGYGSPRIAIPSQLGHRLETKDWKRNMRVLQQGDRLTVGNELKMVVADVVSDNQGRAIILISPMLRTSPTVNEMLEVERPFGIFRFVDNEQGKFQHRRLGYTHITLSFEEVLY

SEQ ID NO: 7612 - protein, 180 aa, Proteus mirabilis
RDVLVNKIKDDIYWMHKAIEQAHKAQQLGEIPVGAVLVADNKIIAKGWNHSIIDNDPTAHAEIMALRKGGKHLQNYRLLDATLYITLEPCVMCAGAIVHSRVKRVVYGASDLKTGAAGSFIDILQHPGMNHKVEITSGVLGEECAQLLSQFFKMRRAEKKQLKQQQRLITQGLIIQEKAK

SEQ ID NO: 7613 - protein, 69 aa, Proteus mirabilis
YLLYGRCKSAVICTRASLNNSFTGIHSLKNSIILLLQLMTAHADFFAWVFWLLSKTDYTGYNTKKNKIY

SEQ ID NO: 7614 - protein, 532 aa, Proteus mirabilis
TMPYWTTACPDWEERIKHGRSIIPPPIYPEQAELALNIFKQLKIVDAPGSPTFGEACAQWIFDLVSALFGSYDAQTGRRYITEVFVLIPKKNSKSTLAAGIMMTALLLNWRQAASYTIIAPTVEVATNAFNPARDMVKYDEDLDDLCQVQTHIRTITHRNTDTTLKVLAADANTISGIKSVGTLIDELWLFGKQANADDLLREAIGGVASRPEGFVVYTTTQSNEPPSGVFKQKLQYARDVRDGKIHDPNFLPVIFEHPHDMVERGEHLLAENMAMVNPNLGYSVDEVFLMREFRKAKETGDASFRGFMAKHANVEVGLALRSDRWVGADFWEPQTDDTLTHDEILRRSEVVTVGIDGGGLDDLLGLSIVGRCKNTRQWLSWSHAWGHSSVFERRKSEVAKLLDFEKDGDFTLVAQIGDDTKEVADIVERIYQTRLMDKIGIDPSEIGGLLDEIVQRGIEQDAIVGISQGWRLGGAIQTTERKLAEKVLFHAKQPLMNWCVGNARVEPKGNAILITKQASGRFEDRCTDGAV

SEQ ID NO: 7615 - protein, 848 aa, Proteus mirabilis
LNKYLLFNYFLFNIIIRRLFMLIPYSPHTIWKTICATLLLSLAFFSQAEQDDSVEFNIHMLDAEDRDNVDLSRFSTSNYIIPGMYYLDIRLNGRDFPRQNINYIEVADNHSVACIDPTLLKKLTINQENQKYIKQISPDCFDISQLPGISIKNDGGVLDITLPRSLMKYEESDWTPPELWDSGVSGLIFDYTLTGTSTRPNKGNNNNTLTGYGQAGLNLGEWRLRAEYQGNYSSEYSSNNRFDWNQIYAYKPLPDLAAKLTVGETYLNSQIFDSFRFTGANLQSDERMLPPSLQGYAPEIHGIANTNAKVTVTQNGRLIYETTVPAGPFVINHLQNTVQGQLDVRVEEQNGKINEFQVQTANLPYMTRPGSVRFNTSLGQSSVNNHKMQGPIFYQGDFSWGMNNTWSLYGGALLTAKDYNAWSLGIGHDMGRFGTLSGDITQSYSKTYDNEKINGMSFKLNYAKTFDEYHSTITFAGYRFSEKTFRSFSQYIDERYNGINNNGYEKEMYTITGNKTFWADDAEKSTTLYLSYRHQNYWDKNTQEQYGVTVSRNFSIMGIEQINTNLSAFRTQYKGNTDDTLSFNISLPLGSGRNIGYNLQDNNGKVTQMASYADNRDYNNLWRIRAGLSSDKKANTDGYYQHRSQYAEINANASYQQDNYLAVGATIKGGFTATRYGAALHSSSMTSSTARIMVDTDGVAGVPFNGQSTTTNRFGIGVLTDLTSYNNVDARIDVDKMDQDIETRKAIASTTLTEGAIGYYQFPVRQGERLMAVLQTTDNKYPPFGAEVTNQKGESIGMVMEEGLVYIAGVNLNESLNVIWNGKTQCSITIPAEITDPLKHLSLVCQDR

SEQ ID NO: 7616 - protein, 63 aa, Proteus mirabilis
VNDFYRFFIVKMIVRFIFSQDAFFSTITDTAINQNNPLLLLRQTKNNLFEIFLQVKSLMPLRN

SEQ ID NO: 7617 - protein, 339 aa, Proteus mirabilis
SLWYQFIITCRNNRVVMKKSWLSALLLAGYLSIPTQALAQPQIGNAEALLQKMGNTTQTATYELSFININSQGIVPIRYRHALVDGKPVAQLMQMDSTRREIVQRGNEISYFEPGLDAFSLRNEHIVDYLPAIIYQNFAELAEYYNFIDAGRTHIGDIPSRVVRVLSKNNDRYEYVLFIDEERYLPLRVDLLDKNNDVIEQFRVITANQNKEIISELDSLNKVNMPPLLLIPKATQALNYNWRVTTLPEGFKEVKRSNHQIAENEFSQSILYSDGLFDFSIYVNKSGQQLNSPERDKALRYGRNTIYTYDKDGNEITFIGQLPFITAQKIVNSVVFTKK

SEQ ID NO: 7618 - protein, 159 aa, Proteus mirabilis
PLIHLFHYFSSPFSIKILGVIMSNALLRELVLNQALKVTPFTYLDNTFYVKELDVGTMNYIQRKLRQIKIKLAEAQDIYLDEDDPEQFNEAINRVYDEYDVARMLAFKLCDEKGELLFDAENEEDLKGLNRLGQGFSNAVFTAEAGNSEKNLENGDNSN

SEQ ID NO: 7619 - protein, 80 aa, Proteus mirabilis
IMDQISATTAIKKACNYVGGQSEMAKRLGISPPTVNQWINGTRKIPARRCPEIEKVTSGVVRCEELRPDVDWSYLRGTQQ

SEQ ID NO: 7620 - protein, 177 aa, Proteus mirabilis
LMYQRPSEFRKALSDCTLISSVLIMKYGKLYAVIAMVGIIVGGYWVINWQANRINLLVETNKELTEALEEQKSINTDYQARIMRLNQLDIQYTQELANAKNEISHLRDISERHPERVYIKAECPKVKTTPSTSLAYATTARPTDTAIRNYWLLRERIAESEQMILGLQDYIRVECVN

SEQ ID NO: 7621 - protein, 234 aa, Proteus mirabilis
INNHMASRRCDRLGWYHDNHIRHSSAEWVAELAHKIRIAWMVDTIRSRLRLDDSHSLTIPDFFAFAVMHKLVDKLPDAILRRILNWPDKTKDRRVHGGFPEADIVPNEVTALSAMNARLDAIKPVINVTVDPEPPASFLLKPKMCRWENTQWLQWVKTQPCCVCGQQADDPHHIIGHGMGGMGTKAHDLFTIPLCRQHHDELHHDPKLWEATYGNQIELLFSFLNRSLGMGALV

SEQ ID NO: 7622 - protein, 83 aa, Proteus mirabilis
RSLHNPVPILGHRFLFILLKTNVAVNITLFKIVYIVVNKGIYLNYHIVLSLFSWQIADWLVITTTVFCDSSLIIIIELNFILF

SEQ ID NO: 7623 - protein, 431 aa, Proteus mirabilis
MNKQIMPIMLSNEPAAACWGEKALISTNETGMTVHLTEENRLGAIQRGGRKIDGQGIRNVALVGDGWDLERSWAFWLGFRAPKGARSIEWPQLSEADKKELESRIRIVDWVRDTINTPAEELGPEQLAQRTVDLFCGLDKEDISYKITKGADLRDQNYAGIYTVGRGSSRDPVYLALDFNPTKDAEAPIFACLVGKGITFDSGGYSIKPSSSMNSMKADMGGAATLAGALALAITRGLNKRVKLLLCIADNMVSGNAFKLGDIIRYRNGKSVEIMNTDAEGRLVLADGLIDASNFAPELIIDAATLTGAAKVAVGNDYHSVLSFDDKLANELLASADQENELFWRLPLADFHRSQLPSSFADLNNIAAPSHTAGASTAAAFLSHFVKDYKKGWVHIDCSATYRKSSVEQWAAGATGYGVRSIANLLLTKAK

SEQ ID NO: 7624 - protein, 103 aa, Proteus mirabilis
ARSHIMSRLKVLKPRIPVLKTKVVKPLDVVTRRVTGSQRQKRRLLKWQENPHCAACGSLLAFPDGFELDHIIPLFKGGKDTIENCQVLCIECHRKKTKEELSC

SEQ ID NO: 7625 - protein, 60 aa, Proteus mirabilis
KAQQQATWWLSKGAITIRLYFKCPCCSGSQYRTSQFDVTVNNPHGAKCIFCKSVMTAQMS

SEQ ID NO: 7626 - protein, 69 aa, Proteus mirabilis
  UNSURE (5): Identity of amino acid at the above locations are unknown.
TSFNXLFLFFLRHISLIYVNPQHHSLRFPHFPKKNKNSDLQIKQKDISCIKNTCYKNHIKLNIFQEQLC

SEQ ID NO: 7627 - protein, 161 aa, Proteus mirabilis
AMLNGKDLGRAIEQAINKKLSSGSVKSKTEIARHFNVKLPSIYDWIKKGSISKDKLPELWSYFSDVVGPEHWGLKEFHLPVNKAESRCTHDEHQLNSLIHAYMSASAERKEIIKYLLLQNNTKEPSWVNSDTRAYIITLERQASEWLNNNKSNKKSSKRPA

SEQ ID NO: 7628 - protein, 202 aa, Proteus mirabilis
KNIKLIIILLFTFFKKSIKLRSPKYCIHNEIMMNKNNPLEVLGHISWLWASSSLHRNWPISLFAINVLPAIRANQYALLTRDSFPIAYCSWANLNLENEIKYLNDVTSLVAEDWTSGDRKWFIDWIAPFGDNGALYKYMRKNFPNELFRAIRVDPKTQVGKVSEFHGGKIDKQLANKIFKQYHYELITEVKNKSDFNFSLIG

SEQ ID NO: 7629 - protein, 258 aa, Proteus mirabilis
EIINMNSFSTLKTLFCGSLLALSLVNTTQAGVSLDRTRIVLTGNENSASVNLKNTSPDIPFLAQSWVENENGQKISSPLVALPPLQRLDGAQKGVVRITKTAEVGLLPQDRESLFYLNVREIPPAPKQANVLQMAMQSRIKLFYRPSAIVPEKPGMVWQDQLVFKKQGNKFIVNNPTPYYITIISLSNKLNGEDSDKLTTFPGLMVAPKASLDIPVKTSNVNQFYMMYVNDYGGHPELKFVCQQDSCKVAPKDQQPKY

SEQ ID NO: 7630 - protein, 155 aa, Proteus mirabilis
VMVKEWATVVHWQQGRALLRYGSSSGCGSCQARAACGSYLLNKIGPETVHQLELPVEQPLVVGQKVEVGIPENSLLRSAMLVYLTPLLGLFIVAGIASLWLSSELAIFCSGLVGGVLGFLLAKNIARWWSKDEGFEPIILQIGLPPNELQVQYQE

SEQ ID NO: 7631 - protein, 374 aa, Proteus mirabilis
SMHKESPIIRRKSTRIYVGNVPIGDGAPIAVQSMTNTRTTDVEATVNQIKSLERVGVDIVRVSVPTMDAAEAFKLIKQQVKVPLVADIHFDYRIALKVAEYGVDCLRINPGNIGNEERIRQVVDCARDRNIPIRIGVNGGSLEKDIQEKYGEPTPEALVESAMRHVDILDKLNFDQFKVSVKASDVFLAVDSYRLLAKKIDQPLHLGITEAGGARAGSVKSAIGLGILLSEGIGDTLRISLAADPVEEVKVGFDILKSLRIRSRGINFIACPTCSRQEFDVIGTVNELEQRLEDIITPMDVSIIGCVVNGPGEAEVSTLGVTGAKTRSGFYEDGVRQKERLDNSNMIDLLEAKIRTKAAMLDGNLRININQLDK

SEQ ID NO: 7632 - protein, 60 aa, Proteus mirabilis
PLNNTQFHKINHLSLNNVVILCLRSVIHSCNCSCPQNEGLKSVEWPKVIHQKIVCSGCPC

SEQ ID NO: 7633 - protein, 412 aa, Proteus mirabilis
RYNKTRYTSPLREHVLGGFFCMLKMGGWMVIPSTLWLALDYFTYFFSYGIFLPFWSIWLKGEGVDPAMIGLLLGVGLTARFVGSLILTPAVKDPSKLITALRLFAFLSLLFTVAFMLGTHWAWLFLVMTGFNVFFAPMVPLGDSLAGTWQKQFPLDYGKIRVWGSIAFIISSSLLGILIDAFGHPIILYGLIASTLALFLTSMLRPKIMPQGKVKKAEHHHVSFMKLISDGPVWRFLLCVSLLQGAHAAYYGFSALYWEKAGYDTATIGYLWSLGVVAEVVVFMFSRRLFRRWSARNLLLLSAFAGLLRWGMMGSFTALPALIIVQILHSGTFTVCHLAAMRFITARQEHEIIRLQAVYSALAMGGSIAIMTIVSGWLYEKLPNQEYLIFWLMAALTIPAMFIRPKVQPQNT

SEQ ID NO: 7634 - protein, 418 aa, Proteus mirabilis
SHRNVTRYIKCSPRFIFIFIFGACMSSIIHFVLALAVIGALAFIASNNRKGIRLRYIVQLLIIEIALAWFFLNSDIGEGFVRGFAGLFDHLLGYAAQGTEFVFGGMMKGGLAFFFLNVLCPIIFISALIGILQHIKVLPFVIRIIGTVLSKVNGMGKLESFNAVSSLVLGQSENFIAYKDVLGKMSQRRMYTMAATAMSTVSMSIVGAYMTMLDPKYVVAALVLNMFSTFVILSVINPYSVENEEDIQMGNLHEGQSFFEMLGEYILAGFKVALIVAAMLIGFIALIAAVNAIFSMIFGISFQDCLGYVFYPLAWVIGIPEQDALRVGSVMATKLVSNEFVAMGSLQDLAAELTPRSVGILSVFLVSFANFSSIGIVAGAIKGLNEMQGNVVSRFGLKLLFGSTLVSFLSAAITGLFV

SEQ ID NO: 7635 - protein, 142 aa, Proteus mirabilis
KVFNCCIVDYHRHYDPKRNVIAMRFKLLKVAALSLVVMTSGCSMFERLVYHPDINQGNYLTPAEVAKVQQGMTQQQVQFALGTPMLKDPFGTQTWYYVFREQPGHQKVRQETLTLTFDNNGILTKIDKQGDMPSFSNQTSKD

SEQ ID NO: 7636 - protein, 68 aa, Proteus mirabilis
HFDKCVNYCRRKETDFRCFLIDKKIMYRLNNTFTPYQTHVDLGRFEIKTGTNQKITTLLHNQGLLLKV

SEQ ID NO: 7637 - protein, 81 aa, Proteus mirabilis
KNSKTHSYFFQSKKLINTNSNQLQFNCFLKKIINFCLNCFDFFYESMKNSSIINKKTESSETNSVFILHLTGYLIYFDFFK

SEQ ID NO: 7638 - protein, 373 aa, Proteus mirabilis
NVSNNAKQGQNMSIEINHVTKYFDRTEVLHDVNLTVNSGEMMALLGPSGSGKTTLLRIIAGLEHQTEGKICFAGQDVSRLHARERKVGFVFQHYALFRHMTVFENIAFGLTVLPRRERPNKAAIDKKVTQLLEMIQLPHLAQRYPAQLSGGQKQRVALARALAVEPQILLLDEPFGALDAKVRTELRSWLRELHSELKFTSVFVTHDQQEAMEVADRIVIMGNGKIEQVGTPQQVWHTPESRFVLEFLGDVNHLQGEINGAQLQIAGYHLPLSVTPLYQGKVDVFLRPWEISLNPHSDSLCKLPVKVIEVTPKGHYWQLVLQPIEWGNTPISAVWNDMTSIPHKGDIYYMGGAKARLYAQERPLTTVSLAYTA

SEQ ID NO: 7639 - protein, 398 aa, Proteus mirabilis
QRGNVMTQSTTPAPSASVAVSKENTVNQKTKINLLDLNRKQMRELFVSMGEKPFRADQIMKWIYHYCYDDFDQMTDINKVLRAKLKEIAEIKAPEVSEEQRSADGTIKWAIKVGSQQVETVYIPEDDRATLCVSSQVGCALECKFCSTAQQGFNRNLKVSEIIGQVWRAAKIIGALKETGRRPITNVVMMGMGEPLLNLNNVIPALEIMMDDFGFGLSKRRVTVSTSGVVPALDKLADAVDVALAISLHAPTDDIRDEIVPINKKYNIEMFLDGVRRYIAKSNANQGRVTVEYVMLDHINDSTEQAHQLAECLKDTPCKINLIPWNPFPGAPYGRSSNSRIDRFSKVLMEYGFTTIVRKTRGDDIDAACGQLAGDVIDRTKRTLKKRLQGEPISVKAV

SEQ ID NO: 7640 - protein, 69 aa, Proteus mirabilis
SISLTRRRSLVRAQYRPPITLKRGNENLVIMKWAVSSVGRASPLQGGGRWFEPNTAHHFIRLFYAISHS

SEQ ID NO: 7641 - protein, 304 aa, Proteus mirabilis
TRVKKMPDNTVTEEKQFKCIGIVGHPRHPEALSTHEMLYYWLLDKGYDVIIDTQVAEELKLTDAQTGDLTQVGKLADLVIVVGGDGNMLGAARVLSRYNIKVIGVNRGNLGFLTDLDPDNALQQLTNVLAGHYREEKRFLLEARVCAEGQRTRIGTAINEVVLHPGKVAHMIEFEVYIDDRFAFSQRSDGLIITTPTGSTAYSLSAGGPILTPNLDAIALVPMFPHTLSSRPLVISSDSQIRLKFSQTNIDYEVSCDSQLVLPIKEGDEVIIKRSRQKLNLVHPTDYNYFNTLSSKLGWSKKMF

SEQ ID NO: 7642 - protein, 294 aa, Proteus mirabilis
WITKSLWQAIKGALMSDIAQQRSLYRRQIDWVKWGLILTGVVLSILFLVVPIAWIFMTAFSKGIEIFTDNLLDSDMLHAVWLTLLIALITVPINMLFGISMAWLVTRFRFPGRQWLMTLIDIPFAVSPVVAGLLYLLFYGSNGWAGQWLEQFDIQLMFSWPGMVLVTVFVTCPFVVRELVPVMMSQGSQEDEAAVLLGASSWKMFWRVTLPNIRWALLYGVVLTNARAIGEFGAVSVVSGAIRGETYSLPLQVELLHQDYNTVGAFTAAALLAMMAIITLMVKSALQWHLERQQ

SEQ ID NO: 7643 - protein, 589 aa, Proteus mirabilis
VGQKKCSDFCASLLYCIKNQFILYVITDMFLYRRGTMLTQLTISHFAIVRELEIDFSGGMTTITGETGAGKSIAIDALGLCLGNRGDANMVRPGATRADLCARFSLSDTPSAQRWLEEHHLDDHNECLLRRTIAADGRSRGFINGTSVPLSQLRELGSLLIQIHGQHAHQQLLEPRYQKHLLDIYANEPALLKKMKAAYQTWHQSCQTLATFQQQSLEREARQQLIDYHLKELNEFQPVAGEYPELDQEYKRLSNCGQFLTLSQNSLQILSDNEEQNILSMLNVAKHEISELSTMESQFNSLLDMLEEASIQISEVSDELRHYSDRLEMDPNRLFELEKRISKYISLSRKHRVTPEELYELHQQLIEEKEALLRQNDDCDALMEQVKIDHAAALDVAKQLHQIRQQYAHELSQLITNSMHQLSMPHGYLTVDTLFDENVLQIDGATKVEFNVTTNPGQPHQALSKVASGGELSRIALAIQVITAKKMDTPALIFDEVDVGISGPTAAIVGKLLRELGESTQVMCVTHLPQVAGCGHQHYFVNKETNGEETETTMKLLTKKERLQELARLLAGSEVTKNTLANAKDLLAA

SEQ ID NO: 7644 - protein, 75 aa, Proteus mirabilis
IKGNSMSNTMTGTVKWFNDDKGFGFITPKDGSKDVFVHYSAIQSDDFKSLMEGQEVSFTMENGMKGPAAGNVVAL

SEQ ID NO: 7645 - protein, 233 aa, Proteus mirabilis
YLMNQNIQQQIDELRVTLRHHEYLYHVMDAPEIPDAEYDRLMNKLKALEAEHPELITPDSPTQRVGALPLTAFEQVRHEIPMLSLDNAFDETTYLAFDKRLRERLKNNEEITFCCELKLDGLAVSLLYENGRLVQAATRGDGTTGENITENVRTIKAIPLRLYGDNIPARIEIRGEVFMTEKGFEHLNEEARRTGGKVFANPRNAAAGSLPQLDPRITTQRPFDFLLLWCWRA

SEQ ID NO: 7646 - protein, 228 aa, Proteus mirabilis
SHMNTLLVNQLQKKLGYTFKQNELLLQALTHRSASSKHNERLEFLGDSILSYVIANALYHRFPRVDEGDMSRMRATLVRGNTLAELAREFELGECLRLGPGELKSGGFRRESILADTVEALIGAIFLDSDIQNIENIILKWYENRLAEISPGDKQKDPKTRLQEYLQGRHLPLPSYVVVQVRGEAHDQEFTIHCQISGIDQPVKGMGTSRRKAEQAAAEQALIQLELE

SEQ ID NO: 7647 - protein, 150 aa, Proteus mirabilis
DLMKLLLTPYIQSDLGVVLLKRGAELLKQFKPHSRVIISDVPKSLDKWPSGALTGNEQPLLDNKGIVDFLNNKKVLQAMGGLSSMNMWIGRNIHCCQINDKHDSYHHHELTTTWHQDGVIDLVGTMIIIFAIHQLNGLLNWLIKFVLLGW

SEQ ID NO: 7648 - protein, 254 aa, Proteus mirabilis
TEVNMSYFEGKTVLVTGAATGVGEGVAQRLYQAGATVFISGRQLEQVKKTAYTIDPTGEKVIALQADMTSPEQVKSMFEAILAQTGALHGLVNNAGITGPHNTSIVDYNIDDWKAVMDTDINGVFYGLKICIPALLRSGGGSIGNLSSTNGIVGIAGIFCYTASKHSVLGITRSAALEFAQQGIRVNAIGPGYVDTPRMQQLPDEVRQWMASTHPMKRMATRKEVANMVAFLLSDESSFSTGAFYAVDGGYTAQ

SEQ ID NO: 7649 - protein, 217 aa, Proteus mirabilis
QEVNMTIETVFSSLKDYLLKLNDEQKIEAINKIKLFLHHISPFKNEPIDCVLWIKQNQVVANDYNPNVMSPTEKRLLKTSLIKDGYTQPVVVLSAQQNKTKQLQWQIIDGYHRYLLSKENTLKKRINNYLPVTILDVKNHTMSDQIATTIRHNRARGQHQVAAMSDIVRDLSRLGWSDKRIGDELGMSQDEVLRLKQICGLAELFSERHFSEAWTVK

SEQ ID NO: 7650 - protein, 76 aa, Proteus mirabilis
CNAKFINLLLNILIHEVSPKKEKPPQAGAEVVGNVRKTKFPHFVLSAENQVINFPDFFKSIQPSTASELLIKRLLM

SEQ ID NO: 7651 - protein, 72 aa, Proteus mirabilis
KEKNNMKTWLMGVYEFFLRYKVVWSETWKIRQQLDAPIREKDEHEFLPAHLELIETPVSKRPRLIAYFIMAF

SEQ ID NO: 7652 - protein, 149 aa, Proteus mirabilis
TLCDLEFVMDVSEQFEVQEIVAVEGSSLQLSVLEPQPEKLTQALSEFFGQHKPIRRAFIVNALEQGDDESFYLIGLEITGEENIIAQILPQAAEAAFEHLEEGQSLDFCFVNKDEQGVSHFMTHHVTPFYQRKLGGFLRKGIPIVNLNT

SEQ ID NO: 7653 - protein, 166 aa, Proteus mirabilis
INGESAKGYLMSLKQKIAAVTTAGATAIALVVIAHFEGVRYEPYRDVAGVLTVCYGHTGKDIIQSKTYSQQECDALLQNDFIKTQQQVDALIKVPLDDYTKAALYSFAFNVGTTTFARSTLLKKLNAGDRAGACEEIKRWVYAGGKVWRGLVSRREAESVLCHGNL

SEQ ID NO: 7654 - protein, 141 aa, Proteus mirabilis
KDIDMKKSIIFLLLPPLIMTPAISIAASNLLSVHILNQQTGKPAPNVEVTLEKKQSSNWVLLNSGKTDNDGRIKAIWPDNSTSPSTGDYRVVFKTGDYFKNQGKESFFPEIPVEFRIDNVNEHYHIPLLLSQYGYSTYRGS

SEQ ID NO: 7655 - protein, 302 aa, Proteus mirabilis
MSEEQTYCGFIAIVGRPNVGKSTLLNQLLGQKVSITSRKPQTTRHRIMGIDTDGAYQAIYVDTPGLHIEEKRAINRLMNRAASSSIGDVELVIFVVEGTNWTPDDEMVLNKLKSLRCPVLLAINKVDNVTDKTKLLPHIGFLSQQMDFLDVVPISAEKGMNVDTIAKIVRNCLPEAIHHFPEDYITDRSQRFMASEIIREKLMRFLGEELPYSVTVEIEQFVTNDRGGYDIHGLILVEREGQKKMVIGNKGAKIKKIGTEARMDMEDLFENKVHLELWVKVKAGWADDERALRSLGYVDDLK

SEQ ID NO: 7656 - protein, 148 aa, Proteus mirabilis
VLMEQLELENALSLLQCTLVAQRTRYTPEQVTWGQYDILELLRLRGDLTPSQLCEILAISRQNLSKFMRGLKSLGFIAQDRSKKDKRELITHLTDEGKAFLARAALGRKQNAQKLQAQLTPAEQAMFIELSHKVINALIADKLPTEPD

SEQ ID NO: 7657 - protein, 209 aa, Proteus mirabilis
NYAEIFMSSKEQNVHEEQVSKEKEGMESVMNESQEQVKSEDAQAEFDAQAELVQALARVDELEKQLQQSQKTEREAMIRAQAEIENIRRRTQQDVEKAHKFALEKFSNELLPVLDNLERALSAADHENEQMKPMIEGLELTLKSFLDAVRKFGIEVVEEKNVAFNPEVHQAMTLIDSPEHEANHVVDVMQKGYTLNGRLLRPAMVVVSK

SEQ ID NO: 7658 - protein, 157 aa, Proteus mirabilis
MMGEIKISGLAELSQCLKALEKNVGKRIARKAMNAGAMELKQEIKHRVPILKEKVPHRRKGTLKRNIRSKTKVQRNGQVKTRIWVKSLSGKKVSAFKQATGKSAALNPNDPFYWWFVEFGTAKMPAQPFMRPSFEAKKEATAKVIVQILKEDIEKAR

SEQ ID NO: 7659 - protein, 196 aa, Proteus mirabilis
KLLLKKKHCANNVSQSPVPTKIIRRRFMGLFDKLKSLVSEEKKGSGTIDIVAPLSGEIVNIEDVPDVVFAEKIVGDGIAIKPAGHKIVAPVDGTIGKIFETNHAFSIESDNGIELFVHFGIDTVELKGEGFKRIAEEGQQVKVGDTVLEFDLAVLEEKAKSVLTPVVISNMDEIQGLTKMTGPVTVGETVVMQIKK

SEQ ID NO: 7660 - protein, 65 aa, Proteus mirabilis
VLACTYKHWQILLVKVIFAIVAIKPQDNRDRNDAAKFASDINRCWCDFNHSFVITRLMDWSKRAF

SEQ ID NO: 7661 - protein, 1302 aa, Proteus mirabilis
KRELNIMEILRGSPALSAFRINKLLTLCQENQLPVRGIYAEFIHFVKVDGQLSEDEQAKLSKLLHYGPSLTEHELVGEMRIVVPRPGTISPWSTKATDIAHNCGLAQVVRIERGIAYYIDSDTMDEEQWQLLYGFIYDRMMETIFTDYQQVNALFAEQTPTPLKTIDVLAHGKDALVAANIEMGLALADDEVDYLVDAFKRLQRNPTDVELYMFAQANSEHCRHKIFNADWIIDGKAQDKSLFKMIKNTFEQTPDYVLSAYKDNAAVMEGSVAGRFYPDTEKGHYRYHQEPVHILMKVETHNHPTAISPWPGAATGSGGEIRDEGATGRGAKPKAGLVGFSVSNLRIPGFEQPWEEDFGRPERIVSALDIMTEGPLGGAAFNNEFGRPALLGYFRTYEEQVNSHNGVEIRGYHKPIMLAGGIGNIREDHVQKGEISVGAKLIVLGGPSMNIGLGGGAASSMTSGQSDADLDFASVQRDNPEMERRCQEVIDRCWQLGDDNPILFIHDVGAGGLSNAMPELVNDGGRGGRFELRNVLNDEPGMSPLEIWCNESQERYVLAVSPEKMPLFDALCQRERAPYAVIGEATQERELVLNDTHFDNKPIDMPLDILLGKAPKMLRDVTSHKTAGEYLDRKDIDLKEAVYRVLHLPAVAEKTFLITIGDRSVTGMVARDQMVGPWQIPVANCAVTTATLDSYYGEAMSIGERAPIALLDFAASARMAVGEALTNMAGCDVQSLNRIKLSANWMAAAGHPGEDAGLYDAVKAIGEELCPQLGITIPVGKDSMSMKTRWQDEQGKTKEVISPLSLVITAFSRVEDVRKTVTPELSTQEGNRLYLIDLGNGHNALGATALAQVYRQLGQKAADLRDVEQLKQFFNVIQQLVSDGKLLAYHDRSDGGLFVTLAEMAFAGHCGLNVDISAYDEDILAGLFNEELGAVFQIKGEHQESVETLFTEHGLADCLHYLGQATPSDDIIIQSRETEVYHEKRSTLRVWWAETTWQMQRLRDNPECADEEHRAKQDSHDPGLNVHLTFDPAEDIAAPYIATGSRPRIAVLREQGVNSHVEMAAAFDRAGFDAIDVHMSDLHTAQRSLSDFDVLVACGGFSYGDVLGAGEGWAKSILFNHRLRDEFAQFFARQDTLSLGVCNGCQMMSTLAELIPGADLWPRFVRNRSERFEARFSLVKVTDSPSLLLQGMAGSQMPIAVSHGEGFAEFRDAAQLAQLEAKNLVGLRFVDHYGQPTEQYPLNPNGSVKGITAVTTTDGRSTIMMPHPERVFRTVSHSWHPENWGEDSPWMRLFRNTRKQFD

SEQ ID NO: 7662 - protein, 153 aa, Proteus mirabilis
EMSCQSIKQVVKAMCEATAGGREAMAGALGLSLTSFNNKLYEKNGCRSFDLNELLAMQDISKTVLFAEFVARESNRLLVDRVNPAELDTTELFTLRSNVDEMQGHLALLMKNSLADGVIDNEEEQKIKMMLDGLISQIHTFMNAFVLLHQKRN

SEQ ID NO: 7663 - protein, 544 aa, Proteus mirabilis
LERLIFMSRKLKLALAQLNWVVGDIEGNCERMLATVKAQEDADLVLFSELALCGYSPEDLLFRPDFQQRCEEQLVRLEQASKKTAIVVGHPWWQNGTIYNALSFFYQGELQARYFKQQLPNYGVFDEKRYFQQGNERCVVPFKGYHLGLLICEDIWINEPIDALKQAGADLVLSINASPYSREKPHIRTQLIKEHCQRTHLPVVYLNQIGGQDELVFDGCSKVFDERGTITHRLAAFDEQVAVVEFDELTIVPMQDAAPELSPLAQVYQALVLATRDYVTKNGFKGAILGLSGGIDSGLTVAIAVDALGKESVQAVMMPFRYTSEMSIHDAKEQADLLGVEFDTVSIEPMFDAFMDQLSPMFKGSAVDTTEENLQARCRAVILMAMSNKRRRLVLTTSNKSESAVGYSTLYGDMAGGFDVLKDVPKTLVFELAKYRNTLSPAIPQRVIDRPPSAELAPGQTDQDNLPPYDILDALLEGYVEQDKSVSDLVAAGFDEAIVRKVVKLVDINEYKRRQAPVGPRITSRNFGKDRRYPITSGFGRHNW

SEQ ID NO: 7664 - protein, 113 aa, Proteus mirabilis
QIIWCRRLLKERKRFIVTKIWVEVAYALPDKQYVIPVELTLGDTVEQAIIASNILTICNDIDLTKNKVGIYSRPAKLSDNVRDGDRVEIYRPLIADPKEMRRKRAEKARQKTE

SEQ ID NO: 7665 - protein, 417 aa, Proteus mirabilis
MLKREMNIADYDPELWNAMEGEVTRQEEHIELIASENYTSPRVMQAQGSQLTNKYAEGYPGKRYYGGCEYVDVVEQLAIDRAKALFGADYANVQPHSGSQANAAVYMALLKPGDTVLGMNLAQGGHLTHGSPVNFSGKLYNIVPYGIDEAGKIDYQDIAEQAKKHKPKMIIGGFSAYSGLVDWAKMREIADSVGAYLFVDMAHVAGMIAAGVYPNPVPHAHVVTTTTHKTLAGPRGGLILAKGGDEEFYKKLNSAVFPGSQGGPLMHVIAGKAVALKEAMEPEFKVYQQQVAKNAKAMVDVFLARGYKVVSGGTENHLFLLDLVDKDITGKDADAALGRANITVNKNSVPNDPRSPFVTSGIRIGSPAITRRGFKEAEAKDLAGWMCDVLDNINDEANIEKVKQKVLDICAKFPVYA

SEQ ID NO: 7666 - protein, 285 aa, Proteus mirabilis
IIIRRTPIMFATASKRVLPGFGLSLGSTLFYTCLILLLPMSALVVQLSEMSWAQYWAVITHPQIVAAYKVTLLSAGVASIFNAIFGMLLAWIITRYRFPGRKFLDGLMDLPFALPTAVAGLTLATLFSTQGWYGLVLDKFDIKVINTWIGIAVAMSFTSLPFVVRTVQPVLEELGPEYEEAAETLGANRWQTFRKVVLPELSPALLAGTALSFTRSLGEFGAVIFIAGNIAWQTEVVSLMIFIRLQEFDYPAASAVASVILLVSLVLLFSINGLQSRFGKRLRGH

SEQ ID NO: 7667 - protein, 73 aa, Proteus mirabilis
REISMSRLAHLVPKKQFRCLPVSGRQSFRYVEIIVSDKQPDNYKKPACLVDRQALKKAWTDFYFSSGGRGNEQ

SEQ ID NO: 7668 - protein, 139 aa, Proteus mirabilis
ANYSLVFTMPHASETDSEKNTSAILTANIHTTDGETQQLTQLICTTSSAGKKQYRIGLQKISDAGAPLLVAIESYWRKNTQESCVYLLEKAKQFIQGHLQQTNTWISMYGLVIVSNASLEEQLPEALLTLIHSKYASLS

SEQ ID NO: 7669 - protein, 180 aa, Proteus mirabilis
KENRRLNDFFLLLIQYNVEIMTKKKSHKPSSATIALNKRARHEYFIEDEIEAGLSLQGWEVKSLRAGKANISDSYVIMRDGEAYLFGATITPLNVASTHVVCDPTRTRKLLLKQRELANLYGQINRDGYTVVALSLYWKNAWCKIKIGVAKGKKDHDKRDTIKDREWKLDKARIMKNANR

SEQ ID NO: 7670 - protein, 95 aa, Proteus mirabilis
WKRLPNSFSIACSVTAVEAVILPNPFAETVNVSFENQFIGLSAEKDIPPMDEQPLNSKTLVLKHKGNQNLGIINTPFHFFVINSIDAKATSFYSR

SEQ ID NO: 7671 - protein, 178 aa, Proteus mirabilis
SKSRSMDYFTLLGMPNRFDIDKQQLASRYQEMQRQYHPDRFAGKSDKEQVQAISFASTINQAYQTLKNPLSRAEYMLSLQGIDIANEQQTMHDTAFLMEQLTLREELDDIEHSTDAENLLADFSARLEKMYTVRYDEMVKTLDSQTWDIAADNVRKLRFLAKLKEQVEHLEERLFDGF

SEQ ID NO: 7672 - protein, 76 aa, Proteus mirabilis
IGRLLKRRGLIFIFQVEGGAMSNENPNQLNRYYKNHRGVVVRYDREKQRVIFMLDGCDDPQCEPVQRFKEKYTGIK

SEQ ID NO: 7673 - protein, 623 aa, Proteus mirabilis
WFLRKIVMSLLQISEPGQTPAPHQRRLAAGIDLGTTHSLVATVRSGQAEALSDSEGRYLLPSVVQYQVDNINVGWQAKQEAEKDPANTISSIKRMLGRSLNDITSRYPNLPYHFHDNNSGLPLIKTPAGIVDPIQVSADILKALAERAIQSLGGELDGVVVTVPAYFDDAQRQGTKEAARRAGLHVLRLLNEPTAAAIAYGLDSGKEGTIVVYDLGGGTFDISVLRLTKGVFEVLATGGDTALGGDDFDMMLADWIRERAGFGYQNDVILQRQLLDIASETKIALSDNDVADININGWKGEITRAEFELLIQPLVKRTLLSVRRALKDADVDVDEVLEVVMVGGSTRVPLVRQMVGDYFKREPLTSIDPDKVVAIGASIQADILVGNKPDSEMLLLDVIPLSLGLETMGGLVEKVIPRNTTIPVARAQKFTTFKDGQTAMSVHVVQGEREMVSDCRSLARFTLRGIPPMAAGGAHIRVTFQVDADGLLSVSAMEKSTGVEASVQVKPSYGLSDTEIANMIQSSMENAKEDLQARRLAEQKVEAARVLESLTAALQEDAHLLTEDEKTAIDNVVDTLIESVEGTDPVAIENAIKQLDKQTQEFAARRMDTSIRQALAGHSVDEI

SEQ ID NO: 7674 - protein, 151 aa, Proteus mirabilis
INLRKITMIRMSSKVVAICLVLLTIGCQSTANKKHVAVPLRLQLGDAYLAEQQYQIAQYHFQKVLSVMPEHPEANLGMALTSQLLGNPIQALDYYKLAMKSKPVNVNVLRFYGNFLCEQNLLNNNNVLIEDIPSDYLVCQHAEYQKSPNSR

SEQ ID NO: 7675 - protein, 66 aa, Proteus mirabilis
RMLRMKLVTCVILVSVIQSGCTSKPSVPKSKPLPPPAWLMQPPPDLLTPLSEIIGYSESELQSQSK

SEQ ID NO: 7676 - protein, 89 aa, Proteus mirabilis
ITIRGDMKIKEPDELIADADKYESKVMFKSMRIAWLIFTIVLLNLIPMLIHGGVLSLSNFLIFNVFIICIMLWIYIRKIFYTYSKRNSH

SEQ ID NO: 7677 - protein, 1037 aa, Proteus mirabilis
PNQSVESGIMGGSGGLISKVVGAGLMIAGLFTGGVTSAIGMALMAAGVAVQVAGSLIFKPKLPSMNYRDTGERKQMLRSSSAPETVIVGKTVISGLLFFAEEEAGEQDENEKITLALALAGHPIEKIGKIWLGDDLIETFGEYTVHEVKHLWLKSLKITAPVVEVELHNNREDVDPFMLKNCPSWKEDMIGRGLAWLRVTLTFDQEKFPYGLPNVKCEVWGKHLFDPRTGQTEWSNNGALVILDYYRHYLKVPDTDIDFDSFKQAADLCDEKVSLPEGGFESRYTLNGAYDLNESPSSVLEAMHKCINAEPTFTAGKHGIQIGAYYGPAIKTITESQLIGTVTCTPETGLKDATNAVYGTFIDAEQLYTKTDFTPVIVDEWVKEDGLEIRENIDYRFVTSPYQAQRLARQYLRKKKAGRRVQLTMNLDGYAYRPGEVVLLELPSLGISGLEFRIAEWSFHALDGVALTLEEDGAYLYEDVIDKPFERPPFVSLPTGGVASPINLTFVPLAVSDIVQGTLSWQNVASDVRYNTVNILQNGKVIQSIQVPAERVDINGLARGTYRVEVRATNMAGAMSAPAISDFAIQAPPAPIKVDVTSGMFSLTVSPKQGDSAVLGYTFEFWFSEEKLANLSENEVITKTNKVGQGNFWTQENLKAGHTYYFYVRTINSYGKSPFVEASGVCSAQTDLILEELTGQISRDQLAQDLLGEINSKADLSAVVELNTQVKANHDAILAEQVARGAVINQEQQARAEADKAEAQQRQFLATQLRGDYTGNDLSKVTAGLISAEKQARVTGDQAEAKARQSLETRMNRNVSAINKSLGTLTSKQQAQTQEISTLNSNLKGKADSSAVNALNTRVSNIDGKMTATAQQVTRLESQVGTSSAKIEQTSKVVTDLNGKISASWTMKVQQDSKGNKVITGIGLGFNAQGNSQFLVNAQNFAVISSLNGKVVTPFVVKNGQVVIHEALMDKAWIQKLVVLNYFKSSGFDKGNGFLLDAKNNIFRFTGGNGALNITNNQLVVKDEKKRLVMKIGYLGN

SEQ ID NO: 7678 - protein, 66 aa, Proteus mirabilis
RTLSHDILKWVKDMKAFNVIRMFQDALVEVTCPSCSYVAKQNKHKLKKNLILLCPNCGYMFYFNKI

SEQ ID NO: 7679 - protein, 304 aa, Proteus mirabilis
VIMSLPDIHRVQSFFLSLQDSICHAIENIDQKATFQQDNWQREAGGGGRTRVLTQGAIFEQAGVNFSHVYGDALPASATAHRPELSGRRFQAMGVSLVIHPLNPYIPTSHANVRFFIAEKEGEDPVWWFGGGFDLTPYYGFEEDVIHWHKVAKSVCDPFSQDYYARYKKWCDDYFYLKHRNEPRGVGGLFFDDLNTPDFDHCFEFVQHVGQGYLDAYLPIVEKRKSIPWGERERQFQLYRRGRYVEFNLVWDRGTLFGLQSGGRTESILMSMPPLVRFAYDYRPEPNTPEAKLYTDFLIHKEWV

SEQ ID NO: 7680 - protein, 170 aa, Proteus mirabilis
NVERNSMMQKIMEVSVLPIMNRELTMSSREIASLTGSNHSDVKRSADRLFVAQILTQPLAEFPFEHNGNQYTEYRFNKRDSLVLVARLSPQFTAKIVDRWQELESKMQPVIPQTLPEALRLAADLAEEKQKLESELAIATPKAQFVDNYVLSHGSMTFRQVCKLLQAKGN

SEQ ID NO: 7681 - protein, 211 aa, Proteus mirabilis
VKERLVEVYSTENEQVDAIKQFLKNYGLTIILAIVIGVGGIWGWKYWQSHQANRLQESAGEFATINEALTKPTPENIALAEKFVSETNDIYGALASLELAQLAIDANDLAKGETHLTKAISMVKNEAFADMLNLRLARVQLALDKTDAALISLEQVKSKAWDGMKNYIRGDVLAKKGDNAGAAAAYRNALNDENAGAIRSLVELKLNNLSN

SEQ ID NO: 7682 - protein, 199 aa, Proteus mirabilis
LRESPSLMSEQLTDQMLVEKVQLGDQKAFNLLVIRYQHKVASLISRYVPQGDVPDVAQEAFIKAYRAIGSFRGDSAFYTWLYRIAVNTAKNYLVAQGRRPPSNDLDASDVENFETSNALKEISNPENLMLSEELRRVVFQTIESLPEDLRVAITLRELDGLSYEEIAVIMDCPVGTVRSRIFRAREAIDNKVQPLIQEL

SEQ ID NO: 7683 - protein, 102 aa, Proteus mirabilis
KKLGERRQFQLILSLALGKTLAEIEQMPESHLCEYEAFYRKQPFGLWREDYRMAQVAHLLAMINRDPKSTPPQLTDFMPMWQKKPTEAEEWDSVTQNVLAHR

SEQ ID NO: 7684 - protein, 190 aa, Proteus mirabilis
IIVGRNKMSRKLLVPLIMTSLSLCAANAQAVGENTLSLGYAQSHAKVDGDKLKEKPKGFNVKYRYEFDNQWGMIGSFVYTHQGYDYHWNSRKIGSIDLDYYSLAAGPVYRFNDYISAYGLVGVAHGQMEVALNNFSYNGKENQQSKSAFAYGAGIQFNPYPNIAIDASYEYTKLDAFKVGTWMLGLGYRF

SEQ ID NO: 7685 - protein, 334 aa, Proteus mirabilis
FMYGLEIFPAEGGKPYRLTHDTQILCYLTSYQIGPEDWPHYRQPKKTRSKVIHEAMGYEAFAIPRVASVYMAVNDYAYFQGITHIRMEGPVLRYEYVYDNVQVQDPQMAKRANMVVDIYGIPLPDSTKPTYGVEWYGAFQGFRSAITRNTQMTYCVFRQKIHLEGGRYWPLPTTLPHLDKCVVFYHATNPQAEVSYLAHKKQLYSSAQTDIYVCVFVSGMVLTPKRRWGLSLYSEDGTLVFNTDYLPFTRGQSMELLLREGSVETPYSLPLVCATSQFVNASYQDDHIDWAKRNTGIRFRGKQIFVSERIRDAHRQHHVEQRIPFYVLNGSLYF

SEQ ID NO: 7686 - protein, 141 aa, Proteus mirabilis
RVYGTGSISMRDMQEVLSRWGAWSANEGNSIDYSSIAAGFKGLIPSSRRSREQCSDDDGLKINKAVLHLKVNNSYLFQLVIMYYVKNYPLRSMASKLGISHNEVAKRLQTAEGFIEGCLSVDNVKLDMDKIIRKHSIYSLV

SEQ ID NO: 7687 - protein, 207 aa, Proteus mirabilis
PYLGKDKVMLTGRKKKFAQALKKGMTQREAAIEAGYSEKTAQVKGSQLAKDPDVTAYLRRSINGNTKVNTHLNQKVNSKVNFDVNTEVNYHLNHEVSNKVNPTINRKINSRVNSNVNSDINAVITDKERSSQVHDYPDPLAVIAEIMMKNKDIDPKLSLDAAAKLAPYLCSKKGDCGKKDEKKKAAKKAGNRFSPMPPPKLIINNKG

SEQ ID NO: 7688 - protein, 773 aa, Proteus mirabilis
MKLGYKRLIAASVIFLLVTPLLLWIADKIWPLPDPEPQIATIVTAEDGTPLWRFADKEGIWRYHVTLSDVSPEYLQALIAYEDRWFYQHPGVNPIAILRAAWQDLSSGKIVSGGSTLSMQVARLIDPHSRTLGGKLKQLWRTLQLEWYYSKDEILEIYLNRAPFGGTLEGIGAASWAYLGKSPADLSAGEATLMAVLPQAPSRLRPDRYPERAQAARDKVLDRLAEYQIWPKEKVAEIKQEQVLLAPRQTPQLAPLLARRMYNEQKAPVITTTIDINLQRQLEELAKQWKYQLADKTSLAILVVDHTDMSVKGYVGSADFNDNQRFGHVDMISAWRSPGSTLKPFIYGLALDEGLIHAESLLQDVPRRFEDYRPGNFDTGFNGAVSASEALSRSLNLPAVQLIEAYGAKKFAAKLRHNHLEMRFPYGSEPNLALILGGTATRMDQLVATFSALARHGKTAPLRFTPEQTINERMLMSPGAAWIIRRILAGEARPRPDSAISAVVPLAWKTGTSYGYRDAWSIGVNARYTIGVWVGRPDGTPVAGQFGFATAVPIMNQVNNLLTSYFYQNKQRPPVDPRPNSVSAAAICWPTGKALPKEDSNCRVSRRSWILDNTIPPTLLNESQEGILGINEKVWIDKEGKRTGPNCPGAQLKDIALWPIALDAWLPEKERRAKRLPPISLTCPPIKEDMIPLYISGIRKGDLLRPLPGETQLEITVSTQGGSGMQWWFLNGEQIGKTENGATFSYLLEKRGKYQLSVLDLSGQTDMVNFSFR

SEQ ID NO: 7689 - protein, 268 aa, Proteus mirabilis
ERIGSMTNLTESTKNLNGFHYFALGWRLITRPGLKRFVILPLLANIIILGSAFWWLYGQIGEMVNWMMEKVPDWLQWLSYVIWPLSVIFILLVFTYFFSTIANIIASPFNGLLAEKLEGQITGINPPDTGLLGITKDIPRILKREIIKVVYYLPRAIVLLLLYFVPVVGQTIAPILWFIFGAWMMAIQYNDFPFDNHKVSFANMKSTLKKDKWNNLQFGMVINIFTMIPILNLVIMPVAICGATAMWCDRYRHQHVQAGPMLLPLVSL

SEQ ID NO: 7690 - protein, 151 aa, Proteus mirabilis
KITGKTMEIRVFRQDDFEAIITLWERCDLISPENDPEIDIERKINHSPDLFLIAEVAGEIVGSVMGGYDGHRGSLYYLGVHPEFRGRGIANALISRLEKKLIAKGCPQITLMIPEENDATICMFEKLLYEDQNQENTAYTKRLIIDQDFDL

SEQ ID NO: 7691 - protein, 136 aa, Proteus mirabilis
THQGQARRITFQRLDADSETWTRRERHEMMNIVTLQEVKSHLRIDHDFDDADLQLKINAATAAVFDHVKSWVERFQGDETKLKQSPDFYRVKDAILILIGIRDRDREGVDIALYPQGMLPYPVTCLLGSMHKPTIL

SEQ ID NO: 7692 - protein, 92 aa, Proteus mirabilis
VIKGKNPMYQQEVTITAPNGLHTRPAAQLVKEAKTFSSDISLISGGKSASAKSLFKLQTLGLTQGTVVTISAEGEDEKQAVEHLVKLMAELE

SEQ ID NO: 7693 - protein, 428 aa, Proteus mirabilis
IEEGITMKSKSVIPASFSLQERDRRWQLARDIMRDNQLDTLIIYGDRESAAPAPFCIDHYFTNDRLGSVVIFHEDKKPLIVTFAPMMIADHMQAKLRGDLQWIDEDNLVVGKTGRSIAHFLKEMGVQQNAHIGIIGLEPYPPFYFDGAMPFNTLNGIKEAFPYAKFSSVYRDFFRRASVKSEEELAHVRYAAAIGEAMSEAMRVTARPGATEAELAAAITATCLSRGGFTAEILMGSGSEYIGWGPPVWQYRSQAPREIQMGDIILSEIFALYGMYETQHQAVVAVGKIHENLEKAALVARECYEIGVEHLKAGITFGEVVDLMEKPLLESGGWHVHPLIHSINPYGPIGFGTAPGIESLPLAHRYKQIERLPNPGRELVLQEGMTFAFEPNCGFGHHLCNLGGTVVVGKSKGIELNSNSTQLMRADI

SEQ ID NO: 7694 - protein, 68 aa, Proteus mirabilis
RRRGTATCFLFAVDWQPIVNNTKQIATTFDDILIIVIFLKLIHSCNSLLCFKTTAQSESYPPLSDCFY

SEQ ID NO: 7695 - protein, 60 aa, Proteus mirabilis
SSRGGVSTMSWKPLIIIISFILALLITVAGGIYLLIDNSCTKDQVSLEKRCQIALSYHRY

SEQ ID NO: 7696 - protein, 1086 aa, Proteus mirabilis
GVFMAGALGRLNIDLTLNTANFINAINRSQRQTEQFGQSIRVSLQAITVQQERMVSQTAKSSALFARFASVTASALSIHQVINYADSWTELQNRLKLVTESSVELNKATQAVYDIAQKTYQSLDATAQVYQRFADNADRLGLSQQKVAELTETVSKAVAISGASATAAQAALTQFGQALASGQLRGEELNSVMEQTPALAKAIADGMGVSVGELRKKAQDGEMTIEKVIQALERAADSVDKKFATSVTTVSQGFTNLQSAITKFIGEANQSTGATQLLTTGLSALSNHFSEVMRVTEALAMTAIAIKIAKWTQATYAQAAATKLKVQQDLIAAKATKAKMTAELELARVEMRSLQAQLQLAQTEAQRSSIRMRMKAQSSIIVSATNAETLAIQRLNAAQRASSTLGRSFGGALAFLGGPLGIATGLLTAGAMAYYEWQQQAEQSRQKALEYAESLDVATESLNKLSDAERQASIGKLAEGLDAQIEKIEELKRKQEDLKKSSDLGGANKGISFYYTGDYESFSAEVVKARKDELQVTADLETKNRELEVTRKKMALLLDAEVQKNGMVSNAYALYASRIYDASVKSDELIGKLHLQGSAFDNLAQSIRSATQEQQQFSAQSLIVISDDAQKSIDASLRTIEKSKATGKALAKLNAEDVLASRKITPDMMGYDKALQAEIEAQLALQSKKIKPPKTPKSTIDYAKQYTKILTELEEKQASLIAYGQSIQLYGTTSSFNEYTSALADIKQNKDKFDAILKIDPKAIEMIKEKAKAIDDLARANSVAQFAYDRGKEIEQMQFETTLIGKSRAEQEKLNALRQIDVLYQQASVDLGEKELVNLQRNVELTKQQIEEELRKREAMKGDPMAGLKQGLSDFSESAMDVMENVRNVTTNALNNMSDALADFALTGKGSFKDFANAVISDITRMVMKMLIFKAIEAGGQAMGFDMGWMSKGHAYGGYTGHGGKFEPKGIVHGGEFVFTKEATAKLGVGNLYRLMHAAQGYASGGFVGAVAGRIPVTPQPTLARAGGVQMTVVNHITVTGNGDAVLAQAMKEAAQQGTEAGAQKAHAMMLQDFQSNGAARRTLGV

SEQ ID NO: 7697 - protein, 275 aa, Proteus mirabilis
GVFMKNLKLLLLAFVTASILSACSNHANVENHEQLTLQNQAVLGLVWTQQSGEYQALTHQAFNIAKTAFEHAIVAKDKKKAVVVDLDETMIDNSAYAGWQIENGQGFSQESWTKWVNARQVYAIPGAVDFANYVNTLNGTIFYVSNRLDKSERQATIDDMKRLGFPNVSDKTLLLKTDKSAKSERFNSILNQGYDIVLYVGDNLNDFGDTTYHKSNSERRDFVTLNAKKFGTKYIVLPNPNYGDWEGGLDKNYYKGDLKNKLNIRNNAIRAWDGK

SEQ ID NO: 7698 - protein, 225 aa, Proteus mirabilis
TVIIINLNIYYSMGNIVLSYLLKRFALFLFSAMIVAITTGFIFLDILVLNNGISETSATELGQELIVAIICFLFFIPAYKQPEMRGGYTLIMGFFLCILIRELDGVFDQLAHGSWVWFALTVTFVCIAIAIREGKKTLYGLTHFITHSSQGMLMAGLLSVLLFSRLFGMGILWEKLLGEDYNRTVKNMVEEGSELFGYTLCLISVIWYRYSSKYHVIPTSIKVTY

SEQ ID NO: 7699 - protein, 252 aa, Proteus mirabilis
YNVIFQEKSMSDILLGVNIDHIATLRNARGTTYPDPVQAAFIAEQAGADGITIHLREDRRHITDRDLMLISQTVQTRLNLEMAVTEEMIEIACQTQPDFCCLVPEKRQEVTTEGGLDVVGNEEKVADAIKRLSLAGIKVSLFIDPDHEQINAADRVGAPFIEIHTGAYADAEDEQAQEKEFVRIRDAVTYAASKGLKVNAGHGLHYHNVQRIAALPELYELNIGHAIIGRAVFSGLAPAVEEMKRLMREARR

SEQ ID NO: 7700 - protein, 453 aa, Proteus mirabilis
KRVICGDRERSIGAGRKTLFCGVYQVNQREKQFTDNLIEAVNNALAKRDARIDSLMEQLALYQQLLQKQENDIAALLLLLEEQASVSLNRLEQRFDAEKNSFEQSLHAFLIQQVKAIPMPKDGRDGHSVTLEEIKPLVDSTVNLAISALPKPLDGKDGKDGHSVTLEEVKPLVDLAVNLAISGLPKPLDGKDGKDGHSVTLEEIKPLVDSTVNLAISALPKPLDGKDGKDGHSVTLEEIKPLVDSAVNLAISALPKPLDGKDGRDGKDGSSVTVEEVKALVMSEVSATVKALPVPKDGKDGRDGKDGRDGKDAFNIDILPDIDETKSYARGTLATHHGGLWRAYEQTKGMHGWECIVRGCSSLAWSLQDERTLLVNSILSNGEMVQTKYVFPTMIYQGVFAINRALPYQKGDVVTWGGSLWHCNEPTKDKPGELHSKGWTLIVKRGRDGRDTK

SEQ ID NO: 7701 - protein, 71 aa, Proteus mirabilis
RSPIRLLLTELKYYANEVKVIELLLYEEPLILLDSCNKDAAAFSSLTSKLPAAEIILLISFINGVRFSLFA

SEQ ID NO: 7702 - protein, 133 aa, Proteus mirabilis
LITIRINEFFTLKKITMGFAIFLLSGCATPEKWQVNMKNPTPLDIAKNLCMQEAKQRYPEHYLSSTPNYSYPSSSTITVDGKEVTIPNSNYHSYSRYDANEAERKQYFDICMRGEGWENKNKVTGLLAFLFND

SEQ ID NO: 7703 - protein, 114 aa, Proteus mirabilis
DITMPKIVFLPHSTLCPEGAVVDATEGESILDVALRNGIEIEHACEMSCACTTCHCIVREGFDSLDESTELEDDMLDKAWGLEPESRLSCQAKVTDEDLVVEIPKYSINHAREH

SEQ ID NO: 7704 - protein, 92 aa, Proteus mirabilis
GVTMRMEKLTNVTYGTAGLTAFFASLSLYEWGFVIGMAFSMVLGLATYFMTRREQRKRTQLFEEIVRHVDPQNPTETLKRFAELMVKAPKDI

SEQ ID NO: 7705 - protein, 410 aa, Proteus mirabilis
VLAIILTILGKGENGAPPNGKLALSGRSKEIKPIENSIVQEIMVKEGELVKKGHVLLKLTALGAEADTLKSQSSLLQAKLEQFRYQILVKSIESNKLPEIKLPNDPDLQNISEDEMLRLTSLIEEQFSTWQNQKYQKELSLDKKKAERLTILTRINRYEKLSQIEKSRLDDFKKLLQKQAISKHAVLEQENKYLEATNELRVYKTQLEQIESEILLAKEEYQLVTQLFKNEILDKIRQTTDSVKLLTLELEKNEERQQASVIRAPVSGKVQQLKVHTQGGVVTTAETLMVIVPENDTLEVTALVQNKDIGFINVGQNVIIKVEAFPYTRYGYLVGKVKNINLDAIENQQLGLVFNVIVSIEENNLSIGNKNIPLSSGMAVTAEIKTGMRSVISYLLSPLEESVTESLHER

SEQ ID NO: 7706 - protein, 142 aa, Proteus mirabilis
YMAIQRTFSIIKPNAVKKNVIGAIYNRFESAGFSIVAAKMLHLTREQAEGFYEEHKGRPFFDGLVEFMTSGPIMVQVLEGENAIQRHRDLMGATNPDNALAGTLRADYADSFTENAVHGSDSEASAAREIAYFFTENEICPR

SEQ ID NO: 7707 - protein, 337 aa, Proteus mirabilis
IMHIRSQKQVSFHQYKKLKRKTLANEQLSMAPASIKRIASHWKQYLCWIMLPMFLAGCAQKSLTETANIEPEPPVVKQKTIDYRWAECKTLAAFYHEGLNNPLFWLRTIECTQRIMSTEAQRQASSVIVAGWDGAFYKSILLERAGMTVAERRAQLVLLESYQLQFPSSMRVLLSTWIENQTLTLALADEKNRNRRFVTETENKMDLLKKQNNALEHELNTTRKKLESLTQIERQLSSRKQGASVDAISQEEALSDVQSSDASNTEKPADKPIAEQSNKSTASEQSITKENNEVSQPSVSAVKPEPPKAEQVKPDAKNTSTEKENSATVKPTETGSK

SEQ ID NO: 7708 - protein, 301 aa, Proteus mirabilis
GSNMSHAQSGILVAHSKFGLFIEAMVVGEIDQLRQGCQQFMQSLSELQKQYPDASLGAVVAFGSDLWKKLSDNNSAPELKPFRPLGKGLAPATQRDMLIHIQSMRHDVNFSLAQAAIAAFGNVLQIEEEIHGFRWIEERDLSGFIDGSENPVGDERYGVALINEGIDAGGSYVLVQRYEHNLKKWARFSESDQEKMIGRTKKESIELDESERNITSHVSRVAIEENGEELAILRHSLPYGTASGKHGLYFLAYCGRLYNIEQQLLSMFGEVDGKYDDLLRMSKPVTGSYYFAPSYEVLAAL

SEQ ID NO: 7709 - protein, 326 aa, Proteus mirabilis
GENMASTFALILTLATLITGIFWCIDRFKLKPARKAKLKRLQELTQGSEDQQELAKSINKPSWAETLGSLFPVLAIVLILRSFVYEPFQIPSRSMMPTLLVGDFILVEKFAYGLKDPITQTTLISTGKPKRGDIAVFKYPRDPSTDFIKRVIGLPGDKIVYDVTSKKLHIYPNCNKAICDDEIAVTYGTAYPSEWTLLLQSVPGGQRISGMKSIPIEEPISTATQFRQEERIETIGDVSHRIMTIPGDVTVPEFIQPGLPQGTWIVPEGQYFMMGDNRDGSSDSRFWGFVPEQNLVGKATTIWMSFEKQENEWPTGVRFSRIGGIK

SEQ ID NO: 7710 - protein, 151 aa, Proteus mirabilis
TENIKVGIMPAFLFLGILIMKQPNWTFKLPETIRAAMSRPFSWGEFDCCIFASECIDAQCGFSPIKPYLNHYKTKAEAFNLIKSKFGSLEKAVSRYFKSIEIEHVQRGDLVLFKGEDGDSLAVVWAGHYWGVTPEGVKPVQINPIKAWRVE

SEQ ID NO: 7711 - protein, 89 aa, Proteus mirabilis
VTDMALLITKKCINCDMCEPECPNDAISMGNDIYEINPDLCTECVGHYDKPTCQSVCPITNTIIIDPAHTESQDELWEKFVLIHHADKI

SEQ ID NO: 7712 - protein, 224 aa, Proteus mirabilis
GMDMAKSKNHKATPFLGTKIFVQTGLGEAMTVTEATLSPATITIANNKLKADDMIMLSGFGELDGRFPVAQVDGNKVTLCDEVDWSDKTLPTDFANAKAQRIQWSNNFCAVKSFSKDGSTTEQIDVTTICSDGKEYESGDTEYGSIKLTFFLRYSSSDVQRLLRKYENSKEKFAVKMVLTRDEGSMFYYGSVETGMNIDGSVGQMMDSGISIKLSGRDYLNAKK

SEQ ID NO: 7713 - protein, 311 aa, Proteus mirabilis
ISLMDTLSQLLYLSQGQLQLDVFCQMKGHFSLPHVSSVEHETIFHLVLSGQCYVQIEKSAPIVLSEGTFLMLNRRQSHTLWSGERDIEPPPFLHKNNGFLPVKYTKSEDQTQHVDLLCGRMAYAKGSGLLLLNGFPDMVVANLVEMPGLTVLNLFSQLLREEAINANQGAAAILNGLAQTLFAFALRVYGQKPDINSSWLALLAEPRLSRVFNSMLNEPQKGWTLDSLANVASMSRATFVRQFKATANTTPGEVLQSIRMLKALSLLQQNKYTLSDIAERVGYQSEAAFSKAFKSVFNCRPGQWKKQQSKV

SEQ ID NO: 7714 - protein, 650 aa, Proteus mirabilis
GVCMENQRSYSLLTIKSVNEKDREIVGMATTPSTDAYGDIVEPEGGVFTLPLPLLWQHNMEQPIGEVIDAKVTPHGIKIKAKIAQIASPPGLSARLEEAWQSMKSGLVKGLSIGFKPLEYAFLDEGGIRFTKWVWTELSVVTIPANKDCHLQTLKSMFQPPAASGSRRVVHLSSQLSAGVSAKNAFNKEHTMNIAEQIKSFEAKRSANDAARLDIMNKAAEEGRTLDVEESEQYDNLTSEIKAVDSHLVRLREMEASQAKQAKPIDVEQNSFREASQLRGGIIKVDEKLAPGIEFARYVKCLAASKGNTTQALEIAKSQYPEQPRIQNVLKAAVNAGTTTDPQWAGTLTDYQHFAGDFIDFLRPKTIIGQFGIGGIPSLFRIPFNVRIPGQISGGKGYWVGQGDPKPLTKFDFQSIQLGFAKVANIAVLTDELVRFSNPAADTLVRNALAAAIIERIDIDFIDPNKAEVTNVSPASITHGVKAIPSTGNPEADVEAVFEAFLKANLSPTSGVWIMSSMTALALSKMKNPLGQKMYPDLSFLGGAFQGLPAIVSQYAGEQLILVNAQDVYLADDGQVVIDASREASLQMEDSPTNSSKTGTGAQLVSMFQTNSVAIRAERFINWRKRRPEAVAYVSGVNYRTVTGGDKSPK

SEQ ID NO: 7715 - protein, 197 aa, Proteus mirabilis
SIIIRTTFKGSSIMKLSKIALAAALVFGINSVATAENETPAPKVSSTKGEIQLKGEIVNSACGLAASSSPVIVDFSEIPTSALANLQKAGNIKKDIELQDCDTTVAKTATVSYTPSVVNAVNKDLASFVSGNASGAGIGLMDAGSKAVKWNTATTPVQLINGVSKIPFVAYVQAESADAKVTPGEFQAVINFQVDYQ

SEQ ID NO: 7716 - protein, 255 aa, Proteus mirabilis
SDSMKQKKVKKAGLRKGGFTFKQFFVAHDKCEMKVGTDGVLLGAWAPITKAKTVLDIGTGSGLIALMLAQRAPQVERIDGIELDEDAALQARENAQQSQWSSLIHIYHHDIYQYAQQAPTRYDLIVSNPPYFEPAVACRNQEREQARYTKTLTHEGLLDNAQQLITDEGLFCVVLPYLIGEQFIEISQRKGWNVVQRVNIKDSADKPYHRILLAFQRQYQGETKPCNIEELIIRNNDGHYTTQFQSWVTDFYLYY

SEQ ID NO: 7717 - protein, 454 aa, Proteus mirabilis
RYTMTATTFSSLELDESLLTALEEKGYQRPTAIQAEAIPAAMEGRDILGSAPTGTGKTAAFLLPAIQHLLDYPRKKSGPPRVLILTPTRELAMQVADQAKELCAHTHLDIATITGGVAYMNHAEVFSENQDIVVATTGRLLQYIKEENFDCRAVEMLILDEADRMLDMGFANDIETIAGETRWRKQTLLFSATLEGNAVIDFAQRILNEPVELNADPSRRERKKIQQFYYHADNLDHKTALLAHLLKQEEVKKSIVFVRKRERVRELAAALEKQGIKASYLEGEMAQTQRNEAIKRVESGKMHVLIATDVASRGLDLEDITHVFNFDLPRTADVYLHRIGRTGRAGRKGTAISLVEAHDYPLLGKISRYIQEPIKYRVVAQLRPVTKAPSQKASFKPSKKVLAKRKAKKVEEKKNVKEKVRARDRKNIGKRRKTATDKTTITAEKTNHIKTEQQ

SEQ ID NO: 7718 - protein, 608 aa, Proteus mirabilis
SKAIEKNNFRMKNIRNFSIIAHIDHGKSTLSDRIIQICGGLTDREMAAQVLDSMDLERERGITIKAQSVTLNYTADDGEVYQLNFIDTPGHVDFSYEVSRSLAACEGALLVVDAGQGVEAQTLANCYTAIDMDLTVVPVLNKIDLPAAEPERVAEEIEDIVGIDATDAVRCSAKTGVGVKEVIERLVKEIPAPEGDPDAPLQALIIDSWFDNYLGVVSLIRIKNGKVNKGDKIKVMSTGQVYNIDRIGIFTPKQVDTTSLSCGEVGWVVCGIKDILGAPVGDTLTAAQKPADKPLPGFKKVKPQVYAGLFPVSSDDYESFRDALGKLSLNDASLFYEPESSSALGFGFRCGFLGLLHMEIIQERLEREYDLDLITTAPTVVYEVEMTNGDIIMVDSPSKLPALNNIEEIREPIAECHMLLPQEYLGNVITLCVEKRGVQTNMVYHGNQVSLTYEIPMAEVVLDFFDRLKSTSRGYASLDYNFLRFQGSNMVRVDVLINGERVDALALITHNDNAPYRGRELVEKMKEFIPRQQFDIAIQAAIGNHIIARSTVKQLRKNVLAKCYGGDVSRKKKLLQKQKEGKKRMKQIGNVELPQEAFLAILHVGKDK

SEQ ID NO: 7719 - protein, 369 aa, Proteus mirabilis
LYQITKANYTVINKADRVTIRIRLTLMGTIMKNKTIRTFALQATVALSLVASSYANAAQLLNSSYDIARELFTQLNSDFKTQWDAQHPDDKVTIKQSHAGSSKQALAILQGLPADVVTYNQVTDVQILHDKGKLIPADWQQRLPNNSSPYYSTMAYLVRKGNPKNITSWQDLTREDVKVVFPNPKTSGNGRYTYLAAWGAFEKAYGNEAQTRDAMTKLLKNVAVFDTGGRGATTSFIERGLGDVLISFESEVNNIRQQYGEDDYQVIVPPVDILAEFPVAWIDKNVQRNKTETLAKAYLNYLYSPRAQEIITQFNYRVNDKAVMAKKADQFPATSLFTIEDVFGDWNQVMKTHFATDGTLDKLLLEGRQ

SEQ ID NO: 7720 - protein, 303 aa, Proteus mirabilis
YKQINDQGFIVAGLEQFIGNTPLVKLQRLSQGLDAEIWVKLEGNNPAGSVKDRAALSMIEQAELRGEIKPGDTLIEATSGNTGIALAMIAAVKGYRLKLLMPENMSKERQASMQAYGAELILVSREIGMEGARDLAQEMERKGEGKVLDQFNNPDNPRAHFTSTGPEIWQQTQGRITHFVSSMGTTGTITGVGSYLKTQSDTVKIVGLQPEEKSQIPGIRRWSPAYLPGIFRKELVDSVIDMSQTEAEQTMRLLASKEGIFCGVSSGGAVAGAIRVAKENPGAVIVAIICDRGDRYLSTGVFG

SEQ ID NO: 7721 - protein, 67 aa, Proteus mirabilis
EFKMKWSDTREIGEALYDLYPDTDPKTVRFTDMHQWICQLDDFDDDPQKSNEKILEAILLVWLDEFE

SEQ ID NO: 7722 - protein, 450 aa, Proteus mirabilis
IRRMCMAGHKSANLLLVDDDPGLLKLLGMRLTSEGFHIVTAESGQEALKLLLKEKIDLVISDLRMDEMDGMALFAEIQRQQPGMPVIILTAHGSIPDAVAATQQGVFSFLTKPVDRDALYKAIDEALELVTTVSDEEWSKDIVTRSPQMLRLLEQAKLVAQSDVSVLINGQSGTGKEVLAQAIHRASPRAKKPFIAINCGALPEQLLESELFGHAKGAFTGAVSSREGLFQAAEGGTLFLDEIGDMPMALQVKLLRVLQERKVRPLGSNRDIDIDVRILSATHRDLPKAMERNEFREDLYYRLNVVNLRIPTLSERAEDIPVLANHLLRESAKRHKPFVRSFSTDAMKCLMTASWPGNVRQLVNVIEQCVALTTAPVISEALVTQALQGENTALPTFAEARGHFEMTYLRKLLQMTKGNVTQAARMAGRNRTEFYKLLSRHGLDANDFKE

SEQ ID NO: 7723 - protein, 238 aa, Proteus mirabilis
CGQIYSPNSNQLIIMKNTSKTAVSTEQTQEKLVQEGIRLFALYGISGLRTRQLAQDAGVNQSAIPYHFGGKLGVYTAVIRYIATELASEIQFDQFDNKLQFLLKENRPYKNEKVAELVLLLVTGLTRALLSSKRHYYSQLILREQLEPTENYDLIYSNLIEPFHLRLSRLVGLMDTKSDEVTITIRAHALIGQILGFVIARKAFLLRVNKQEITSQLLDKIVQEISQLSVNALLIENA

SEQ ID NO: 7724 - protein, 366 aa, Proteus mirabilis
GGKMSLLLLKSRPLVVIPELAVRLGLNEAMLLQQIQYWLTETTSGVEYDGSRWIYNTVEEWKEQFPFFSESTIKRAFANLKKQGVLRIEQINKSNHDRTNYYAINYDHHLLPDEVNMTQSTSDNSSNRIVQNDLIDKRKLKPSNSSKCAVLNRSKWPDLQENTTEITSESTTETDHSSQNSDESSDQPKNDFLTRYPEAVIYSANFQKWGDEGDLKTAKWMFGRVKKLNPSALEPTWYDWANDIRLMRQIDGRTHEQICALFDWANKDSFWYQNILSPRKLRKHFDELFVRSQKPKDELKVQVDTVERDSAFSRLIGSRSKPKNRIEEVALELAGKTGIRRMSEFSGRQAWNSIWKQAIEMLQETQ

SEQ ID NO: 7725 - protein, 375 aa, Proteus mirabilis
PLKINNLNINKLDAGRNKMILNKKNIHSKSVMLFCAGIVSLMPLHAIAYLQGEVRTNGGPNIFYAVLDHTTFPNNKAGELATVNFSLPDRYDGTVYCPNSRIYDRALTYFKATTDLPPVGNNFYQLNEYVDIKINFEIWGPNPLPTVPFSDIPNNRNNQQGCRVPSSPKPHISSGSSGQLTFRLRKPIINGVSLNGQSLAQMYAMVSHSGTPKTYGSEPISKLVITSGIITTKDKCIFNNGSPITFDFGNVGNTSDYLNGQNYKITRNIPIKCEGGSFTDPNSRIMFKVQTGSSGIASFNSNYLGTTGSVDRSNLGIVLRDKSGTIIPPNQYFSVGKLNNFNGNWEVSAAPIAKAGSKITEGEFSAHATLIAEFM

SEQ ID NO: 7726 - protein, 152 aa, Proteus mirabilis
EIGIEKVSILRFIPKECCLIPSPVCWGPCTNRLFCEVTMIGTAAGRFRHIITLQQPEPKPNRISGDEVIWRDVLKDIHASVEPLRGREYFQAQQVQSETTFRIRMRWFPQVKSTMRVRFGSRIFDIVAIIDPEERHRELQLMCKEGVNDGGD

SEQ ID NO: 7727 - protein, 198 aa, Proteus mirabilis
GGVVLMQYHPFSDAMVNAINEGAYIVLAARLDLKSGVTCAHTGVGQLIIAGETYLGVGSLGEISQLKENKTTSPPQLQLKLAGFDKSLVGMVMNEQSRGREVRLMMVAIGEEGKPLLAEILFVGQITSINVVSGEENAVCVNVSNRFERWSIGLPDRFTDESWSSRRQGDRIFRYVAQMAERAIYWGSKKDAPSFIYK

SEQ ID NO: 7728 - protein, 515 aa, Proteus mirabilis
YLHVKYHQIYDCIFMRHQKMIPVIALVGRPNVGKSTLFNRLTRTRDALVADFPGLTRDRKYGRAELDGEEFIIIDTGGIDGAEEGVETHMASQSLQAIQEADIVLFLVDARAGLMPADQGIAKHLRGVEKKTYLVANKTDGIDIDTALADFYSLGLGEIFPIAASHGRGVSQLIEQALLPIVGKVVEEEKELTEEEENAAYWAALEAEQKEQEEEEEEEDFDPTTLPVKLAIVGRPNVGKSTLTNRMLGEERVVVYDMPGTTRDSIYIPMERDDKEYILIDTAGVRKRGKVKETVEKFSVIKTLQAIEDCNVALLVIDAREGISDQDLSLLGYILNSGRSLVIAVNKWDGMTQEDREQVKDMLDLKLGFVDFARVHFISALHGSGVGNLFESIQEAYTCATRRVGTSMLTRIMKMAEDDHQPPLIRGRRVKMKYAHAGGYNPPVVVIHGNQVSDLPDSYKRYLMNYFRRTLQVMGTPIRIQFKEGENPYADKKNKLTASQIRKRKRLMAHLKKSK

SEQ ID NO: 7729 - protein, 63 aa, Proteus mirabilis
  UNSURE (56): Identity of amino acid at the above locations are unknown.
PKSVGVKKSNLQPARNPNPNRADATTGGPLFLIMTLTISKGTNITCEMSYPGCINXLVPFLIV

SEQ ID NO: 7730 - protein, 430 aa, Proteus mirabilis
RKKVAQKIQAIRGMNDYLPADTRVWQKIENTLKQILAGYGFSEIRTPIVEHTPLFQRAIGEVTDVVEKEMYTFTDRGEDAQSLTLRPENTAGCVRAGIEHGLLYNQEQRLWYLGPMFRYERPQKGRYRQFHQLGAEVFGLQGPDIDAELIMLTARWWKALGIAEHVTLELNSIGSLEARAKYREALVAFLEQHVDQLDEDCKRRMYSNPLRVLDSKNPEIQTLLNDAPELFDYLDDESREHFDGLCALLDAVGITYRVNQRLVRGLDYYNRTVFEWVTSALGSQGTVCAGGRYDGLVKQLGGHPTPAVGFAMGMERMILLVQAVNPEFVADTHVADVYLASFGDNSQSAALMLAEEIRDQLPTLRLMTNHGKGNFKKQLGRADKHGAKIALILGEDEINAGTVAVKDLRSGEQTIVSRSELAQQLTLLLG

SEQ ID NO: 7731 - protein, 249 aa, Proteus mirabilis
VTEVEGWQRAFVIHARPYSETSLLLDFFTENEGRVRILSKGARGRRSPLKGALQPFTPLLIRWSGRGEIKILRDAEPISLALPLTGTVLYSGLYLNELLSRVLENGTSYSTLFFEYLSCLQILAASETTPEAALRRFELALLTQLGYGLDFLHCAGSGEPVSDTMTYRYREEKGFIASLVVDHYSFTGLELKSLAKREFPTAGTLKAAKRFTRMALKPYLGGKPLKSRELFRQFAIKKCAKKSVLIEDK

SEQ ID NO: 7732 - protein, 414 aa, Proteus mirabilis
SILVIVMSCKRKIPLRINVLDATLDRVKWLFDTFEQITLSFSGGKDSTALFHLIATEARKRHRKFNVMFLDWEVQYSATISHVAKMKSLYEDCTERFYWIALPITTESGISQYEPTWTAWEPGKKWVRQPPEDAITDPDFFPFYHPNMIFEDFTPAFNQWITGNHCSSVILLGIRADESLNRFIAINNNRKLRYADDIPWTTASPEGFYYMAYPIYDWHVKDIWTYISRFNLPYNSIYDLMHQAGVSLNQMRICEPFGPEQRKGLWLYHVLEPETWSLACERVSGADAGMLYTHPRNKSGFFGQRKISKPAHHTWKSYAHFLLASLPEQTAEHYRNKIAVYLHWYAERDYPNGIPDEQDGDTSSKQIPSWRRICKTILRNDFWCRTLAFSPTKSHCYDRYCKRIQEKRKNWQLI

SEQ ID NO: 7733 - protein, 335 aa, Proteus mirabilis
WRMVISSDLIKNHVPRIKMSKIFEDNSQTIGHTPLVRLKHFGNGNILAKVESRNPSFSVKCRIGANMIWDAEKKGILKPGVELVEPTSGNTGIALAYVAAARGYKLTLTMPDTMSIERRKLLKALGANLVLTEGAKGMKGAIDKANEIRDSDPSRYLLLQQFSNPANPEIHEKTTGPEIWNDTDGKVDVVIAGVGTGGTITGIGRYLKNTQGKAVTMVAVEPKDSPVISQALAGEEIKPGPHKIQGIGAGFIPENLELSLLDRVIQITNEEAFETARDVMTKEGILAGISSGAAIAAAVKLAKEPEFANKEIVVILPSSGERYLSTPLFADISDS

SEQ ID NO: 7734 - protein, 117 aa, Proteus mirabilis
LNKVNIMLNWNEYRKQLMGRIGELGKLTPDTVTGYQALSNAGKKTNHLDAKTRELIALAVAVTTRCDGCIAVHADTALKLGASHEEIAEALGVAVALNTGAAMVYSARVLDAIAPEN

SEQ ID NO: 7735 - protein, 119 aa, Proteus mirabilis
KSKVEIMIQQLKETLSPLVDGRVFFQVLPEGKGQYPAIVIQFASITPNSALEDMDLDNYRVQLDVYAPQPQPLMVLRKKIEAKIVEAIPFAQRVNAVFGYEADVKLHRLVLELMILSDK

SEQ ID NO: 7736 - protein, 1036 aa, Proteus mirabilis
VKFFIDRLKVNYMSTMTTAQIKTSLQSAKQLATKKFQSAGQTTKDALKKVADQARNAGNKLILLIPKDYQGQGSSLNELVKVADELGIEVQYDEKNGTAITKQVFGTTEKLLGLTERGVAIFAPQLDKIIQKYQKIGNKLGGSAENIGDNLNKAGGVLSTLQNFLGTALSSMEINELIKKQKNGENVSSSELAKASIDLINQLVDTASSLNNNISAFSQQLNKLGSVLSNTKHLNGVGNKLQNLPNLDKLGTGLDTVSGILSAISASFILSNADADTGTKAAAGVELTTKVLGNVGKAVSQYILAQRVAQGLSTSAASAGLIASAVTLAISPLSFLAIADQFKRANKIEEYSQRFKKFGYEGDSLLAAFRKETGAIDASLTTINTALGTISAGISAASTASLIGAPISALVGAITGIISGILEASKQSMFEHVANRMANTIAEWEKTHGKNFFENGYDARHSAFLEDNFKLLSQYNKEYSVERSVLITQQHWDELIGELASVTKNGAKTLSGKSYIDYYEEGKRLEKKPNEFQKQIFDPLKGNIDLSDSKSSTLLKFITPLLTPGEEIRNRKQSGKYEYMTELLVKGVDKWTVKGVKNKGSVYDYSNLIQHALVGRDQYREIRIESQLGDGDDKIFLAAGSANIYAGKGHDVVYYDKTDTGYLTIDGTKATEAGNYTVTRGLGGDVKILQEVVKEQEVSVGKRTEKTQYRDYEFKHIDGKDLTAIDNLYSVEEIIGTNRADKFFGSKFSDIFHGADSDDYIEGNDGNDRLYGDKGNDTLRGGNGDDQLYGGDGNDKLIGGTGNNYLNGGAGDDELQVQGNSYAKNVLFGGKGNDKLYGSEGIDLLDGGEGNDVLKGGYGDDIYRYLSGYGHHIIEDDGGKNDKLSLTDIDFQDVAFKREDNDLVMYRFENNALSIGHKNGITFKNWFKKESNDISNHQIEQIFDKNGRIITPESLNKAFEYQQKNNQANYVYGHHASTYANKENLTPLINEISKIISAAGSFDVKEEKAAASLLQLSNNISGSSYNSNSITLTSLA

SEQ ID NO: 7737 - protein, 448 aa, Proteus mirabilis
PLSFSWVGDFMPILTNIAQAVVKRLAGLGEGWLTIFREPFTGAWQQNMALSREEVLTYHPVFSCVTLIASDIAKMPLLLKRKGHDGIWHEQNKGAYTVIVTPNSLQTRNQFFENWLNSKLTTGNTFVFKVRTPKGKVQELKILDPNRVKPLITDKGEVFYQLSTDNISGIAQSVTVPAREIIHDRFNCLYHPLMGLPPVYACALSAAQGTAIMKNATHLFVNGGKPSGVIEVPGKISEEDAHTLKKLWETNYGGKNAGKTAILTENAKYKTLSFNPVDSQLVEQLRLTAEIVCSVFHVPLYKVGLGEVPSYNNVEALDQQYYSQCLQSHIEAIEILLAQGLDLPLFEKIEFDLDTLMRMDTATRFKAHNEGIKGGWLSPNEVRKKENLAPVEGGDTPYLQQQNYSLAALSWRDKQKMPTSFDKSELFVETVNEASVQDEKHYFAECIK

SEQ ID NO: 7738 - protein, 464 aa, Proteus mirabilis
ILVLQPSAPLISFCYGVGVLEGGELPTSHYARLQQFKKWGLPVSDAIKLCTGTKAVLDFYHHVAEIHPNLGFDIDGVVIKVDDIALQEELGFVSRAPRWAIAYKFQAQEQMTVIKDVEFQVGRTGAITPVARLDPVQVAGVIVSNATLHNADEIERLGLRIGDTVVIRRAGDVIPQVVSVIEEKRPENAQEIVFPTQCPICQSDIERIEGEAVARCTGGLICAAQRKEALKHFVSRRAMDVDGMGDKIIDQLVEKEYVKTPADLFRLDEKILSGLERMGEKSAKKLLNALEKAKSTTFARFIYALGIREVGEATANGLTAHFVSLEALREANIEALKAVPDVGDIVAKHVVNFFQEEHNKNVIDQLVNDIGITWPAPVVATHEAGDNPFAGKTVVLTGSLSQLTRDEAKDRLVALGAKVSGSVSKKTNMVIAGEAAGSKLAKANELGITVIDEDEMIRLLDQSK

SEQ ID NO: 7739 - protein, 73 aa, Proteus mirabilis
SNVFPFMSSMAHFIFKSFCIHINNVMNFKFYLLIFLTYFMNIITTANARYTVLISINHNPYLAHVCVGFFLTL

SEQ ID NO: 7740 - protein, 201 aa, Proteus mirabilis
NGVFIMPKFWLPLCLSTSVLLLSGCSSMGGMSFSALNPMNWFSNETLTVSANGLGNITASTAVTEQAIEKELGSRFHYRQGMEMQQGNIIVIVQALEDEKVQVAFYGQEKGTVDKITVSDPNAKTAWGTTIGTPFKDIYKKAFGMCSNGPKVDKQKTIQCQSEQAKSVSYVFAGQWDGPDGLMPPDETLANWQVTQIVWQK

SEQ ID NO: 7741 - protein, 85 aa, Proteus mirabilis
SLSFLLDKAIEIMLEKQHLIDIANTQMPFGKYKGRMLVDLPEEYLLWFAKKGTFPEGKLGQLMEMTLAIKIDGLEGLLKPLKQSH

SEQ ID NO: 7742 - protein, 366 aa, Proteus mirabilis
YSPLWLLNLKTTEIEMMQQNLRLILIVVGAILIIALLLHGLWIGRKERSKLFRNRPVKRQKQNYQSDENDDEPQYTEANHQMSSLTSTQEAQSVPPVKSEPTLAPQSSVADKDPLMSGTPAQGHSNDTSLQREPSLGVFDVIEQNNDSAPQQKQPIPEVEVNHADVKEGDISETKLADVEPIPESSNSVASDEIHTTDTDRPLDAETSSDVKQAEQALSGSEEPKAEEELVLVLNVSAHHGQMLDGEVLMQSIIQAGFQFGAMNIFHRHLNPTGNGPVLFSLANMVKPGTFNIDTMAELTTPGVSMFMMVPSYGDANQNFKLMLQAAQRIASDVGGVVLDEERKLLTPQKIELYKSRIRRTLDLHQ

SEQ ID NO: 7743 - protein, 399 aa, Proteus mirabilis
FIQLKGSSDMQLRKTLLIGLLASALLAGCSSEQDNVTMSPLPEVQSQFTPYVVWDKSVGNGIGKYYSHLSPAWDGSVVYVADRHGVVKALELETGKEIWSQDLSTKKGFFSSNESALLSGGLTVSGTRVFVGTEKAKVYALNTDDGSIDWETDVAGEAISKPVVSDGLVLIHTSNGMLQGLDLLTGEVSWTVNLDTPSLSVRGESAPAVAYGAAIVGADNGRVSAVVLSQGQLVWQQNISQVKGSTEISRLNDVDITPIIDENTVYAMAYNGNLVSLDMRSGQIIWKRDLGSVNDMVLLGDNLYLVDQNDRVLAVRKSDGVTLWTQEDLLHRNLTAPAIVDGYLVVGDAEGYLHWIDTSTGKFIAQNKVNSSGLLSRPQAVQDKLMIQARDGKLYLYRR

SEQ ID NO: 7744 - protein, 77 aa, Proteus mirabilis
EDKLMAVIQKINVGEKANDGTGDTLRDAFVKANQNFEALNTAVQKGGADPNGDLGKELSKELEALTLRVESLEKTKE

SEQ ID NO: 7745 - protein, 77 aa, Proteus mirabilis
NYFSLLLCSINLALASFMDTKRKLYIAGVMIDDAFYTLETLYSKKRSSNTNIYDKAYLYLCIVTALSLDRNLIFIYQ

SEQ ID NO: 7746 - protein, 405 aa, Proteus mirabilis
AMKLPIYLDYSATTPVDPRVAEKMMQCLTIDGIFGNPASRSHRFGWQAEEAIDIARNQIADLIGADPREIVFTSGATEADNLALKGVANFYQKKGKHIITSKTEHKAILDTCRQLEREGFEVTYLAPKSDGLIDLKELEAAMRDDTILVSIMHVNNEIGVVQDIAAIGELCRSKGIIYHVDATQSVGKLPIDLSKLKVDLLSLSAHKVYGPMGIGALYVRRKPRIRLEAQMHGGGHERGMRSGTLAVHQIVGMGEAYRILKEEMADETKRLNELRLRLWNGIKDIEEVYINGSLEHTAPNILNVSFNYVEGESLMMALKDLAVSSGSACTSASLEPSYVLRALGLTDELAHSSIRFSLGRFTTEEEIDYAIEQIHSAIGRLRDLSPLWEMHKQGVDINSIEWSHH

SEQ ID NO: 7747 - protein, 576 aa, Proteus mirabilis
IMISGILASPGIAFGQALLLKEEPIIISQRKIQSDEVDTQIERFKDGRNKSAQQLEIIKARAEKNLGADKAEIFEGHIMLLEDEELEQEIISLIKSDKKTAEAAVQSVIEDQATALEALDDEYLKERAADVRDIGKRLMRNILEMPIIDLSAISEKVILVATDLTPSETAQLSLDNVLGFITDLGGRTSHTSIMARSLEIPAIVGTSNATETIKKEDYLVLDAINNKIIINPSDEELEALKAIKEEYLHEKEELAKLKDLPAITLDGHQVEVCANIGTVRDVAGAERNGAEGVGLYRTEFLFMDRDSLPTEEEQFQAYKAVAEAVGSPAVIIRTMDIGGDKDLPYMNLPKEENPFLGWRAIRICLDRKEILHPQLRAILRASAFGKLRIMFPMIISVEEIRALKAELEILKSQLREENKPFDESIEVGVMVETPAAAVMARHMAKEVDFFSIGTNDLTQYTLAVDRGNELISHLYNPMSPAVLNLIKQVIDASHAEGKWTGMCGELAGDERATMLLLGMGLDEFSMSAISIPRIKKIIRNANFDDAKALAEQALAQPTAKELMDLVETFTKEKTLC

SEQ ID NO: 7748 - protein, 73 aa, Proteus mirabilis
RTPSKWAITTNAMAVAPAVVTAAIFCLRDIKYPLALSPLIQQTFLGFQLGFVGQHVEQSLQIIECVFVVLDES

SEQ ID NO: 7749 - protein, 71 aa, Proteus mirabilis
TTGSMSKSESRSTTSNVCSSRLISWCKTNWLISRLMGALLYPDSFCARIQTSPTFTIKGYNRKIINLIAEK

SEQ ID NO: 7750 - protein, 131 aa, Proteus mirabilis
AKLSFYPSVILPPKSINKASQMKKLLFLLIFTLAGCDSQSEIYGHWKNINSDCDVLCSFSIKKQDTAYSDAVVIFDKGPFYKAASGPLIQDKNNKNRYLVRGATGDFLLVLKNGRFFGTNNNFIYEKISEE

SEQ ID NO: 7751 - protein, 308 aa, Proteus mirabilis
TRRLAMLELLLQPFEYNYMVKAIWVSALVGAVCAFLSSYLILKGWSLMGDALSHSVVPGVAGAYILGLPYAVGAFFTGLLAALSMTFIRHITRLREDAVIGFIFSTFFAFGLLLVSLNPTAVNVQTIILGNILGIADEDVWQVVIITGVSFLILFCMWKDLLVVFFDEVHARSIGLSPLKLKIIFFTLLSACTVAALQTVGAILVIAMVVTPGATAYLLTDQFKRLAIIAICIGTVTSAVGAYLSYFFNGATGGVIVTMQTALFLLAFLFAPKHGMLAARRRARQSSQALISQSQHPKDVTQQEEVQL

SEQ ID NO: 7752 - protein, 478 aa, Proteus mirabilis
GTLSNSANTPTFYIHDYETFGTHPAMDRPAQFAGVRTDMDFNIIEDPLVIYCKPNDDYLPQPEAVMITGITPQIALKHGVSEAEFTRQIHQAFSQPNSCIMGYNNLRFDDEVTRNILYRNFYDPYAYSWQKGNSRWDLLDVLRACYALRPEGINWPENDDGFPSFRLELLTKANGISHENAHDAMSDVYATIAMAKKLKQAQPRMFDYFFNLRDKRKVQALIDIPTMTPLVHVSGMFGAARSNLSLVAPLAWHPDNRNAVIVCDLAADISPLLTLTSEQLRERLYTPRSELSADEPPVPIKLLHINKCPIVAPKNTLRSQDADRIGLDIDNCLNNQAILLSNPEIRNKVVEIFAQQTPFTPADDVDAQLYNGFFSDNDRSAMEIIRSTQPQNLPALNLTFEDPRMEPLFFRYRARNFPATLTYDEQQRWLAHRKEQLTPEKLTEYINTIQLLAEEHSDNEEKLKQLQELYLYAQEIAS

SEQ ID NO: 7753 - protein, 437 aa, Proteus mirabilis
RYMSLTKIVIVGGGAGGLELATKLGDKLGRKKKAEITLVDRNNSHLWKPLLHEVATGSLDDGVDALSYLAHGYNHHFNFQLGTLTGLDRQHKNITLAAIYDENQELLVPERQLDYDILVMALGSKSNDFGTPGIKEHCIFLDSPQQAHRFHNEMLNLFLKYSADSNAEAENRKVNIAIVGGGATGVELSAELHNAVRQLNSYGLKKLAPSALNITLVEAGERILPALPVRISSAAHQELTKLGVRVMTKTMVTSADEKGLNTKDGEHIDADLMVWAAGIKAPDFMKDIAGLETNRINQLVVKPTLQTTLDDAIFAIGDCASCPRKEGGFVPPRAQSAHQMASRCYSNILAMLKGKTLKEYVFKDHGSLVSLSKFSTVGSLMGNLMKGDMMIEGRIARIVYISLYRMHQIALHGYLKTGLMMLVGSINRVIRPKLKLH

SEQ ID NO: 7754 - protein, 356 aa, Proteus mirabilis
VKESFILKNGNYFMNDKKTINTHTPLLTNIRNLLIQGRKNTVQAVNSIMVQTYWEIGRLIVEDEQHGDNRAKFGKRVLQTLSAELTKEFGKGFDTSNLRYMRKFYLTFPIRDAVRHELSWTHYRTLLKLKNELARQWYIDEAITQSWSARALERQISTLYYERLLSTQGKQQSIYPVLAEGKQKTTELATSVKDYLRDPYIFDFLGLPSSILQENKLEQTLIENLKEFLLELGKGFAFVERQQRISTNDGDFYIDLVFYNFHLKCFLLIDLKMHKLTHQDVGQMDMYVRMYEEKKRRHDDNPTIGLILCTEKNHTVAKYSILNESKQLFASKYMLELPSEKELILQLEKERQKLFE

SEQ ID NO: 7755 - protein, 60 aa, Proteus mirabilis
GVRSMAVQQNKPTRSKRGMRRSHDALTATHVSVDKTSGETHLRHHVTADGYYRGRKVINK

SEQ ID NO: 7756 - protein, 111 aa, Proteus mirabilis
KHMFVFNGQQIETDSHGYLKNSNEWTEEMVPILAELEEIELTEQHWEIIRFVRQFYLEFNTSPAIRMLVKALAQKYGDEKGNSRYLYRLFPKGPAKQATKLAGLPKPVKCI

SEQ ID NO: 7757 - protein, 645 aa, Proteus mirabilis
FTMPLISLTGAYLAFSDAPLLDNTDLFIDENERVCLVGRNGAGKSTLLRVLAKEQPLDDGQVVYEQDLVTARLQQDPPRDIEGTIFDFVAQGVAEDAQYITEYHRVSKVIETDPSEKNLNRLAQLQEVLDNRNLWLLDSRIAEVLEKLGLNGEAELSSLSGGWLRKAALGRALVSAPKVLFLDEPTNHLDIETILWLEKFLKDFQGSIVFISHDRSFIRNMATRIIDLDRGKLSSWPGNYDKYLESKEEALRVEEQQNAEFDRKLAQEEAWIRQGIKARRTRNEGRVRALKALRVERSERREVLGSARMQVEEATRSGKIVFELEDVNYSIGTRRLVRDFSAKVQRGDKIALVGPNGCGKTTLLKLMLGDLKADSGRIHCGTKLEVAYFDQHRATLDPDKTVMDNLAEGKQEVMVNGRPRHVLGYLQDFLFPPKRAMTPVRALSGGERNRLLLARLFLKPSNLLILDEPTNDLDVETLELLEELVDAYQGTVLLVSHDREFVDNSVTECWIFEGDGVINSYVGGYYDAQQQRAQSVSLKNEANKSRNAPEKTEKETKPKQNAKKATRSNNKLSYHLIRELEQLPAKLERLEEELGCLQEEVAAADFFTRPHEETEKVLKALADKENELETAFDRWQELEMMQNGE

SEQ ID NO: 7758 - protein, 66 aa, Proteus mirabilis
MAAFQLILVIFGGVGTTSMGGSIGLGGSVGSVGVTGSTGAGGCCGNIDGQPASKNTAATTNSIFFI

SEQ ID NO: 7759 - protein, 338 aa, Proteus mirabilis
RRAPMSLDINQLVLHQLIKRDEQTLEVVLRDSLLDIEPVVQEMVEELHRVYSAKSKAYGLFNEESELAQALRLQRQGEEEFLGFSRAATVRLKDELAKYPFAEGGTVLFCHYRYLAVEYLLIAVLNSCNSMWVNDSLDVSSTRYLDIPHADIIARIDLTEWETSPDSLRYLTFLKGRVGRKVSDFFMDFLGAQEGLNTKVQNKGLLQAVDDFCEASDMNKQERQTCREQVYSYCNEQLQSGEEIALTELAQELPPLGDQNFAQFTEEKGYELAETFPADRSTLRQLMKYSGSGGGLTVNFDAKLLGERIFWDPATDTLTIKGTPPNLRDQLQRRVSEK

SEQ ID NO: 7760 - protein, 88 aa, Proteus mirabilis
HIAFYPFSRNSDFMPQKSRYSDEQVEQLLAELVSVLEKHHTPTDLSLMVLGNMVTNLINTSIAPAQRMLIADSFVHALRASIDEGNIH

SEQ ID NO: 7761 - protein, 154 aa, Proteus mirabilis
NRKPLFFYPYAILESLMSVVVGVGVIIVNEKGEVLLGKRCGKHAPYWSIFGGHVDPGETFEQCAIREIEEEIGITIPTPEVIGISNNLQTYQLEGKHTVSICMLAQYQGGEPKLMEPDKCSELRWCSPDDLPEPHFEASRNSIALWKSKRFYQP

SEQ ID NO: 7762 - protein, 63 aa, Proteus mirabilis
RLAFAINAGIIAAQIVAASPAKPIAYKKPSGKIIAKIVGGTKVTMADFKRPVPVFENLKKSAK

SEQ ID NO: 7763 - protein, 188 aa, Proteus mirabilis
YEYTGLHYNTFRYYAPDLGRFTQQDPIGLAGGINLYAYAPNPLTWVDPWGWAKLFALGTYGELNGSVHVGDQLQAHELLRHEYLKQQGLANTSRLSGNPSIALDLDHHTRGPLKDTRGIGGAHWHEAEIRANQGLGKNEFASTLKRELDITSGGLRKSGVPASRVKQLRQEALKFYKQQVAAKVKSCK

SEQ ID NO: 7764 - protein, 174 aa, Proteus mirabilis
YEYTGLHYNYNTFRYYAPDLGRFTQQDPIGLAGGINLYAYAPNPLTWVDPWGLAGCPVDILKNARKNNHAISAEQRQQIIDSIENPKLQKMFKELYRPGANIPDGGTVASILYTKNTGQLVGGSDHINKGKDYLTALKNLSSGNGRYKNEALSPSDRSLASYMINDLRNALGHL

SEQ ID NO: 7765 - protein, 349 aa, Proteus mirabilis
LVDTLTNLTIALDAMGGDFGPRITVPACLRALASNPHLKILLVGQPDSISPLLANQNAELISRLHVIPAEHIVANDAKPSHAIRASKGTSMRVALDLVKTGEAQACVSAGNTGVLMGLAKLRLKAIDGIERPALVSVLPNQKKSKTVVLDLGANVNCDSQMLVQFAVMGAVMAEEIAGIHSPKVALLNIGEEESKGLDNIREAATVLKATPNINYIGYVEGNELLTGKTDVLVCDGFAGNVSLKTMEGVIRVFLSLIKSSTGDNKKTSWWMKLLKKWLQKRLNKRFGHMNPDQYNGASLLGLRGIVIKSHGGANENAFTAAIEQAVQAIERQIPERIASRLNTVLPKSD

SEQ ID NO: 7766 - protein, 695 aa, Proteus mirabilis
SSDTEANQSMNKLLNVAFAIGLALTGTSAVMADKPATPAMVTINQLPTLKQEPQHSTVSERVTARFERSHYRQFSLDASFSEKIFNRYLNLLDYSHNVLLASDIAQFDKDKTKVGEYLKTGELGPLYDLFNLAQKRRFERFQYALNRLNQPIDLTGQDKFQLDRTKAPWPKTRAELDKLWDEKVKYDWLTLKLSDKTDSEIKETLTKRYKAALRRQTQSQSEDVFQIIMTAFAREIDPHTSYLSPRNTEAFDSEMSLSLEGIGAVLQMDDDYPMINSMVTGGPAAKSKALKVGDKIIAVGQHNKPMVDVVGWRLDDVVALIKGPKGSQVKLEVISDEKGAKPRTITLTREQIRLEDRAVKLTEKVINGDKIAILDIPSFYVGLTNDVKTQLQKVAKDNVSALVIDLRGNGGGALTEAIALSGLFIPSGPVVQVRDNNGRVRQDYDRDDVVYYKGPLVVIVNRFSASASEIFAAAMQDYGRALIVGEQTFGKGTVQQYRSLTRVYDQMLSPDWPSLGSVQYTIQKFYRINGGSTQLKGVTPDLLLPSFDNSEMGESNEDNALPWDSIPPANYKLSEYSEKIKQALPTLADQHAKRIANDREFSYIFDDIKRYNEAKAKGEDKFIILNFAEREKENKELEAIKLQRINQRLKLEGKPPLKSLDDLPKDYEGPDPYLDETANIADDLAKVLKPKKLLN

SEQ ID NO: 7767 - protein, 108 aa, Proteus mirabilis
IGDTMIKLEINNTEYIAQLEEARLSVDNPRGYLFMDIVFSDPRFDKNTFEMKNVRREPMRTYMTEAVARDLFEKLGRYFNHKNMVLTSKNIKNLCSLSNLKPSFSLVT

SEQ ID NO: 7768 - protein, 321 aa, Proteus mirabilis
KIATMKSFNQVQFVTIDGDEAGQRIDNFLLARLKGVPKSMIYRIIRKGEVRVNKGRIKPEYKLAAGDSIRIPPVRVAEKEEHAVSPKLEKVSALAECILYEDEHVMLINKPSGTAVHGGSGLSFGVIEGLRALRPEARFLELVHRLDRDTSGVLLIAKKRSALRSLHEQLRLKQMQKDYLALVRGQWQSHTKVVQAPLLKNILQSGERVVKVSSEGKPSETRFKVEERFEFATLVKASPVTGRTHQIRVHTLHAGHPIAFDDRYGDRDFDTQLASTKLNRLFLHASSLTFIHPSTGEKMRIEAPMDKTLRYCLQVLRNQKS

SEQ ID NO: 7769 - protein, 227 aa, Proteus mirabilis
SRRTIPTLTTKIIMKNSKFIVIEGLEGAGKTSAIQTVVDTLKQQGITDLAFTREPGGTPLAEKLRELIKQGIEGEKVTDKAELLMLYAARVQLVENVIKPALAQGKWVIGDRHDLSSQAYQGGGRGIDKALMKSLRDTVLADFKPDLTLYLDLDPAVGLARARARGELDRIEKESMDFFYRTRERYQALAKEDASIITIDASQDIDKVQADIRDVLNQWLTQENSAL

SEQ ID NO: 7770 - protein, 88 aa, Proteus mirabilis
LNRFSSMDPSHQKYYSLLISTQFTFIGAIASCITLIKDYCQNLDVLTYKLTFLKKLKSKLNQLDSNIISIILLGLIMFTLSFITIKGN

SEQ ID NO: 7771 - protein, 296 aa, Proteus mirabilis
VFLTPRSGCMSTKYPIVLVHGLAGFNEIVGFPYFYGIADALRQDGHQVFTASLSAFNSNEVRGKQLWQFVQTLLQETQAKKVNFIGHSQGPLACRYVAANYPDSVASVTSINGVNHGSEIADLYRRIMRKDSIPEYIVEKVLNAFGTIISTFSGHRGDPQDAIAALESLTTEQVTEFNNKYPQALPKTPGGEGDEIVNGVHYYCFGSYIQGLIAGEKGNLLDPTHAAMRVLNTFFTEKQNDGLVGRSSMRLGKLIKDDYAQDHIDMVNQVAGLVGYNEDIVAIYTQHAKYLASKQL

SEQ ID NO: 7772 - protein, 438 aa, Proteus mirabilis
IELTLTFWSQNDFIRRLTMNKDAKKYYVILSALLFFFFFTWSSSFSLISIWLHQYVGLKATDTGLIFSAISLIALCAQPLYGFIQDKLGLRKNLLLVIAVLLILSGPFFLSFAAILRWNIFIGSILGGLYVGMTFNAGIGVLESYTERVSRIRGFEYGRARMWGSLGWASATFIAGHNINIDPNYNFFMASIAGVIFLILLALLKTDKPDAFNQLEHGKPSALTINDALNLLSLPRFWALILFVVGTCIYSVYDQQFPVFFSSQFASLQQGNEMYGYLNSLQVFLEAGGMFVAPFLVNKIGAKNGLLLASSVMAARIIGSGLVEGPIMISCMKLLHAVELPILLISIFKYNSQHFDKRLSSTLYLVGFQCVSSIVATLLSPLAGYGYDHYGFAPTYMVMGCMVVGTTLLSAVLLRADSKALPQHDMTDLDSNNKAQPI

SEQ ID NO: 7773 - protein, 90 aa, Proteus mirabilis
VEITLYKAPINIFIGALLVISTTIEIIYLYGLLPFLTKLVLIYYFSVRKIHIDDILCFILKKLKNSLFLAPYYLTKIIHLNLFIIQKNNK

SEQ ID NO: 7774 - protein, 707 aa, Proteus mirabilis
NIGFITDKKEFNDRLFVIYCRNYRMELKSTPMGQRLAQHPYNRVKLLNAGIEVSGEKHQYLIPFNELIDIFCKKGIVWGELEFLLPDNKVVRLHGTDWEETQQFYRYLYQTWQIWSQEMSEITAQVLEKQLSSIQDIIQSDKWIKQNQLAGIQQAIQESFSAIPLPLERLAQFDNCKVHYQRCLQWLQQGKALIAQENEQWITRILTEHAEFFTTIETSPLNESQCKAVINGEDNILVLAGAGSGKTSVLVARAGWLLRRKLATSEQILLLAFGRKAAEEMNQRLSERLNADITAKTFHALALFIIQQSTKKQPKISELEINSEKRRTLLLTQWREQCQQKKAQAKGWREWLSEELAWDIPDGEFWYDKKLENQVAVRLERWISLLRMQGGSQKTMIDSVPAEYTDAFKKYLKLLAPLLKAWKTALKEENAIDFSGLLHQAINLIEKGRFVSPWKHILVDEFQDISPLRAALLNALKQQNTQTSLFAVGDDWQAIYRFSGAELLLTTAFHQSFGDGAECALDTTYRFNSTIGDVANTFIQQNPNQLAKPLNSLTKGNKKAVVLLPDDQLESLLNKMSGYVSDDETILLLARYHYLQPDLLKKAKTRWPKLKLQFMTFHASKGQQADYVIILGLQSGKDGFPAPARESIIETALLPPVEDYPDAEERRLMYVALTRAKKQVWLLFNKQQPSCFVSELKSQGVPTQKKP

SEQ ID NO: 7775 - protein, 62 aa, Proteus mirabilis
PNKTAAVVGVAYFADHYLIQYSDDMHNTHVKMLFVVRCLTDLRQKMSLMNLPYQYQRHIPNQ

SEQ ID NO: 7776 - protein, 60 aa, Proteus mirabilis
ASKTNLDYYTVGNNCLENRLFLYITPIIKYGDILFFILKKLSNLIGLTIVTLIILGDVNA

SEQ ID NO: 7777 - protein, 111 aa, Proteus mirabilis
KFKTQVSFFLLITKYRIFMKNIILALGLLSLSSVAVSAELTKSCEDYFKETDAYVALMEQNDATKAQAETMKAQYAQSKEQFAALPKDVQESTCKQALDSLEQMKKMSAGQ

SEQ ID NO: 7778 - protein, 234 aa, Proteus mirabilis
RVKTNIIFPLAILLLAGCADPNHQTAKKETPRFLNSQPVEHRVNNASISTAQWKNTPFDEHIKQASARYGVDETLIKAIIQVESNFRPEVISKSNAVGLMQIKASTAGRDIYQNRGKAGQPTTAQLKDPATNIDLGTAYIQLLRERHLSGISNPETLYYATILAYVNGAGALLRTFDKNRDAAIAKINAMSADDFYRYVEKNHPASQAPRYLAKVKAAYHLADNFSDKLAAAAD

SEQ ID NO: 7779 - protein, 122 aa, Proteus mirabilis
DDRTMNRKELIEYIQKTYAVIPEYLWSKYPNYAVFRHHNHSKWFAVIMDVAENKLFDTGKNNKVDVINLKVPVPLVGALRLKKAVYPAYHMNKEHWISIRLDTDFDDAELKSLISESYELTQ

SEQ ID NO: 7780 - protein, 434 aa, Proteus mirabilis
MRGAVVCSGQHSCHEEQHEQILCPQCDLVVSVPELAQGTKATCPRCHTLLTARWRQPFYQPVALAISALFMLLMACQFTFVSMEVAGITNNITLMQIPTVMFSENYVELGAFFLLFVQVVPAFCMIAILLLCTPIKLPRKLQIWLSRILFQLKSWCMAEIFLAGILVSFVKLMAYGDIGLGLSFLPYVLYCLLQIRAFQCLDRHTLWEKLESRPAYPKIESGKTGLKQGVRLCRSCTAILPADQYECSRCEVKGYARKPHSLQWTLSFLITSLILYIPANLLPIMVTESLGNNLYSTIMAGVILLWEDGSYPVAMVIFIASIMVPSLKMVAIGWLCWDAHKAKGKRDPARMHFLYEVVEYVGRWSMIDVFVIAVLASLVRMGRLMSIYPDFGVVLFALVVVLTMFSAMMFDPRLTWDKCTADDDKPMIKEPKGD

SEQ ID NO: 7781 - protein, 106 aa, Proteus mirabilis
MMIASKFGIGQQVRHKLLGYLGVVVDVDAEYSLDQPNEDDIASNMTLRSAPWYHVVMEDDEGQPVHTYLAEAQITYELSDEHLDNDSMDELSQSIRNQLQAPRLRN

SEQ ID NO: 7782 - protein, 136 aa, Proteus mirabilis
MSYFIAMIKVCRVGVILIPTAQTRSEVVMKKYLTILCSLLVSSSISFAWASTAQQTTGQIYVRGAIVDPACEINFTLDQAEYQCYKNNKVFTSTQSIFPTSFEQSSSIILPQNMGKAEIRWMDGAEKNGLINVQYF

SEQ ID NO: 7783 - protein, 172 aa, Proteus mirabilis
FVLAWEILPWIIYYRVNGRRLILFKPHVTVACIVHANNKFLVVEETVNGKATWNQPAGHLEANETLIQAAQRELWEETGLTLPVQYFLKLHQWVAPDNTPFLRFLFLIEAPEQLATQPHDDDINGCYWVTAQEIINSQQLRSPLVKESILCYQQNERYPLSLLDSFGSTFAS

SEQ ID NO: 7784 - protein, 140 aa, Proteus mirabilis
SYLAIKRIMNKLASILAALILTASVVGCSDEKAPDNSAVKADNSSNVAQNTDPKKEDESASSFKKNFISSCILGSGVTDDALIPQITEVCSCTYDNIIKDYGMTEFIRVDMEMRKDGSKSLPKEWNIDKIVEQCISTITK

SEQ ID NO: 7785 - protein, 987 aa, Proteus mirabilis
YKLALNFLEIMAYFMKNIVIPTSLSCFFLLFSHSTWSETNISQTKQRIIDQRNYWLDEIKNGVITTSPQKGSRTAELDRIISNNYQAITGKRRELAEADKSQSHTYVLNTYANILFGDKAKSINFSDIQAYQDLNKLHSTGTYAYDTNKKRVRSIDFILKELFLRGRPYQVLDKEGHYLDNYTTITGSSYPSGHTWNGYKQAAVLSILFPEKGSEMFARAIEYGESRVIVGAHFATDTIASRIGNYYLLSQMLADDDTTRTFVELAKEVRQNVASQCKNQHCLTTSTTITNDETGYYATKDPEPAPRITPNEIPTSANALLRLRFAYLTKEQRQSILASTTYPSNSLAGWAANKDDPNANWGLINLPKAYNGPSYFYNHFIVNQITNEFDFAEFGQLDEWKNDISGPGKLIKQGNGTLILSGNNHFAGIEVNQGHLLLTGENHYAKNSSINGGTLLLEGTLNTLLDVNKGALLLNGGSVDSQVNINNKGILSGKGKINKLAVYSGGIVSPGHSIGTINIDDTVIFNSGSNYHVEINSQGDSDKIISLGTATLNGGMVNVSLENSQNLLTKDDVQSLYNTKYTILTADHGVNGQFTDVNPNYLFLGTTLSYDKNSVILNVGRNNTAFSSVAKTKNQLSIANAIDALPLGHPIYESIIRMDTGNDARSAYNQLTGQIHADILSNQLNNSRQIKETLLSQIKNAEIINREKESAGNKGHVWAKILSNWEKTSNDGNANSYDASTYGVLLGADQRVSHDKMLLGIATGITKTSLSGDNSHANSENYHLSLYGGYDFDTIALRAGASNTFHRIHTTKSVNYGVQSDKNKANYNGNTSQIFIEAAYPITLSDTQLEPFVNLEYAKTKNATINEQGGRAALQAHSQTLESTTSTTGLRLNNQWKFNSKSTGSLYGELGWRHQYNDVERGIHLRFTQTQPTFIANSVDAARDALVVKAGTTIQINETSKVSIGYSGLVARNQHDNGIDMKLSIAF

SEQ ID NO: 7786 - protein, 611 aa, Proteus mirabilis
LSIAVLLQDRYQLLTLYVNFHVHYSIIKTVTLKNNELEWQALRPDYASYQTFFQTASQLPASSLREVQPRLYESLQWLNNAEAGQFMLLKAEDSTAYFETLADTLQQAEIKTYPVVGAYQAESNQIYWQENVEGSFSSSESIACCQWIEPEQLFGSFYYHKDKLLVNPGLLHKVNGGILVLSIKTLLAQPLMWFRLKKMVEEQHFEWLVWNDHQALPLPIEAMPLHLRVILVGDRLSLEELEFMEPNISSTALYGEYEYDMYLEDETALSQWCGFVNGLCQKYRLPSLSADAWQVLLTQGAREHEDQLILSLDLEFLLRQLRYAMRFNHDAYLGAEALKKAQENRLWRHSYLLERSRDEILQGQVTIHTEGEMVGQINGLSVLDYPGYPDLIGEPTRITCVAHIGDGELVDIERKAELGGNIHAKGMMIMQAYLNSELRLDQPQPFSASVVFEQSYGEVDGDSASLAELCALISTLSQHPIDQQIAVTGAVDQFGQVQPIGGVNQKIEGFFDICQQRGLTGSQGVIIPLANVRHLVLNDSVIQAVKENKFHIWPVVHVAEAITLLTHQPYYEEQCENPQSNEHLLAVIHDRITQANNQDRPKLPWFLRLFR

SEQ ID NO: 7787 - protein, 213 aa, Proteus mirabilis
QKIAMANQFNNRSKLRKSHALAGQKKPSRPRGERKVIIFNKPFDVLVQFTDDSGRKTLKDFIPIPDIYAAGRLDRDSEGLLVLTNDGKLQAKLTQPNKKTGKVYYAQVEGIPTEIALQQFREGLNLKDGKTLPAKIERVEQPTWVWTRFPPIRERQSIPTSWLKITLFEGKNRQVRRMTAHIGYPTLRLIRFSMGNITLDNLLPGQWKEINFV

SEQ ID NO: 7788 - protein, 189 aa, Proteus mirabilis
GMTAEGHLLFSVATLVLAQKLEITPVLAQGDWFHMIPAVLLGSLLPDLDHPGSILGRLFRIISLPLSKLCGHRGFTHSLLAFCGLAILWETQVAPYITISADFFHALLLGYLSHLLADMLTPSGVPFLWPLKMRFALPILAKKNSKKGERFISVIILVGALFLPPHLTFSLPTQINHWLQMYHDKRTPF

SEQ ID NO: 7789 - protein, 263 aa, Proteus mirabilis
KKKAIVSVVIVCQKKGSFMYPVDLHAHTIASTHAYSTVSEYFQQAKKKGIKLFAITDHGPDMDDAPHEWHFSNLPVIPRMVDGVGILYGIEANIKNIKGEIDCTEKMSKKLDIVLAGFHDPVMGSLGMVDNTKALIATISSGLVQVITHPGNPKYPIDIKEVAKVAAEFNVALEMNNSSFIHSRVGSEKNCIEIAKAVLDAGGLIALGSDSHIASSLGNFERVLEVLAEIQFPQQKILNTSPRKVLDFLQAHGKKEITEFQHF

SEQ ID NO: 7790 - protein, 62 aa, Proteus mirabilis
FNHFLSFADYYFVYFLFFLFSSLSRRFIAYFSLAFRLFGYVLNCVVCQLKYYIFVKCKKGDI

SEQ ID NO: 7791 - protein, 421 aa, Proteus mirabilis
VIFYIGHVMSEVTSIAKRPSILGGAMIIAGTAVGAGMFSIPIVTSGVWFTGSIFLLIYTWFCLFMSGLMILEVNLHYPLGSSFHTITKDLLGKGWSTINGLSIAFVLYILTYAYISAGSSIIVQNFANVVSLPQAVAGLVFALVVAFFVWLSTRAVDRLSTILIGGMIVAFVFAIGGLFTEVKMPVLFNTTESHASYLPYALAALPYLLTSFGYHGNIPGLVTYYRKDGKAVMKSLLIGTLISLAIYILWQFVVQGNIPREGFKQVIAEGGNIGNLLAQMRINTANTSVSFLLDLFSYMALASSFLGVSLGLFDYLADFFKFSNTGTGRLKSAIVTFVPPTILAIIFPDGFLYAIGFAGLAATIWAAIIPALMAKASRQRHQQQSFKAPGGTFMIIFVILFGAINAIAHILANFNLLPIYR

SEQ ID NO: 7792 - protein, 234 aa, Proteus mirabilis
SGNFMENQPKLNSSKEIIAFLAERFPKCFIAEGEARPLKVGIFQDLVEHLKDETQLSKTQLRSALRLYTSSWRYLYGVKEGAKRVDLNGNDCGELEAEHIAHARTQLAEAKARVQAQRAEQRAKKREAEGDKETSKRPAAKKPNPRRQAPKDGEKRQPRPQKQANQAPRKAPRQNTEKLTPVKDISVLTVGQSLKVNVGSSVMDATVLEIAKEGVRVQLPNGLAMNVRTEHLKF

SEQ ID NO: 7793 - protein, 88 aa, Proteus mirabilis
IFSYLARRFNSFFISTITLHVAFILKKTFKITIAFFYLKESFDYKEKLKFCFPNKSKKDIDKLVMENLSPLGMLYSKLAWHGFGAITD

SEQ ID NO: 7794 - protein, 257 aa, Proteus mirabilis
FHYYRLYTRLGGPQLFSQQRRYVMSNTPLLQCHALCKQYQDGAISTQVLKSVSFAINQGDFMAIVGSSGSGKSTLLHLLGGLDSPTSGEVIFKGQSLNKLTSTAKADLRNTQLGFIYQFHHLLPDFTALENVAMPLMIGGMSAVKAKQKAMSLLDAVGLTARAHHRPSELSGGERQRVAIARALVNDPALVLADEPTGNLDQKNAEGIFELLMKLNKEKKTAFLVVTHDLSLAARFQRQLEMKDGQLESQEAISGVE

SEQ ID NO: 7795 - protein, 327 aa, Proteus mirabilis
IQYYPRVIDSMYTKILGTGSYLPVQVRTNADLEKMVDTSDEWIVTRTGIHERRIATEEETVAKMGASAAENALEMADIDRQEIGLIIVATTSGSHAFPSAACQIQHALGIADCIAFDVAAACSGFVYALSIADQFIKAGTVKQALVIGADRLSHALDPNDRGTIILFGDAAGAVVVGASEESGIISTHLHSDGRFGELLALPYQDRENQDLPAYVTMAGNEVFKVAVRELAHIVDETLEANHIDKSELDWLVPHQANLRIISATAKKLDMTMDKVVVTLDRHGNTSAASVPTALDEAVRDNRIQRGQLILLEAFGGGFTWGSALIRF

SEQ ID NO: 7796 - protein, 108 aa, Proteus mirabilis
LINYAKPLSIARIRTLLYKSDEKGTDMFSFDKMITPSIITIVYRIFISLSILGGLVTIFSGGISLWQLFITLLGVVVSILFIRITFEMIIVIFDILKTLKEINNKLDK

SEQ ID NO: 7797 - protein, 72 aa, Proteus mirabilis
KYNYSYLLLYMLIILYIKLSTIHAFYKPEKSSAVYIIIIYLFVFYCNFSIKNTGQYQKRCYQPTHRNRKKIK

SEQ ID NO: 7798 - protein, 78 aa, Proteus mirabilis
YINYYLQPMSPRLPLVLIFFAYKHPVYLSKIHYMITLFFYTVLVVYKYSYLSKKYNRNNKIKYQYINRKIAKNNISSY

SEQ ID NO: 7799 - protein, 156 aa, Proteus mirabilis
RRNYMPNIKPFSLFPTLSDNLLSNRFDQIDRLFSQLTGSKPISSPTQTYNLKQIDDNHYELTVSVPGYQEDDLSVSLKGSRLLIEGKKEEKLEEDNDKWIHRGISQGQFTLQFDLGKNVKIEKADLSSGLLTIAIEYELPEEEKRQTIAIENKDKS

SEQ ID NO: 7800 - protein, 297 aa, Proteus mirabilis
VLCYQNTSDTLRSYLMIAITGATGLLGQHVIENLLQTVPANQIVAFARDVKKGSSLSQKGVLVRQADYNDKASLITALQGVDKLLLISSSEVGKRTIQHRNVIEAAKSADVQFIAYTSILHADRSPLSLHVEHVETEKMLADSGISYTLLRNGWYTENYLASVPAALEHGVFLGAAGDGKIASATRADYALAAARVISEEGHIGKVYELAGDEAWTLEQLAKELTKQSGKQVIYNNLSQADFVAALKTAGLPDKLSNMLADSDIGASKGGLFDDSHTLSKLIGRRTTTLAESIKAIL

SEQ ID NO: 7801 - protein, 248 aa, Proteus mirabilis
STNFLIILMKLSTAKQKLSLILLLNLVGLTLFLSWYLPAQHGFWLSIDTHIFYFFNRQLLPDSSFAMFVAYVNNRAFDVIILLAMGGLYYHTFRQKDYQGKRHLIIVGIVMVLSAIVINQIGQNIPIERPSPTLHFHDVHRVGVVTGIPTKDASGDSFPGDHGLMLLIFCSFILRYLSFRSFLCALLITVIFSLPRVMAGAHWASDILVGSISLTLVTTSWLLITPASDIIIHWLDEHLPFKGKKAFS

SEQ ID NO: 7802 - protein, 566 aa, Proteus mirabilis
ELYYHLVDYYFRFSGDYMTNTVIKYVLDRLYDLGIKDIFGVAGDYAFPIEDTVCNNQQQRWIGNCNELNAAYAADGYARIKGMAALSTTFGVGELSAINAIAGAYAENLPIFHLVGMPASGVQKSKRLVHHTLGNGDFDVFYQIAQRLACAHTILTPENCVEEMERVIDVALKERRPVYIGIPSDYANSQVVEPLSVTAPQKPTSDKATLEKAVSAIIEKLTHSNNVCVLPGFLSARLGLTDKIQHFIDKTGLPYATMFMDKSILSESNAQYVGMYDGQLMTPEVREFVESSEYILGIGTLMTDFNTGSFTANMKSEQLISIMPDYVEIDSVIYSCVYMTDILSELTQRLPNKTYHKITAKGLGEAVASDNDKITAQYLYPRLEKFFKPNDIIIAETGTSSMGLGFALLPEGAQFHNQTLWGSIGWATPAALGAALAAPEKRIILITGEGSHQLTVQEISQFVRFGLKPIILVLNNDGYLIERLLCDYPEAYYNDLAQWNYHQLPQAFGATDWYSEKVTTASGLDNALNKAALTNSASYIEIVTERYEASELAQKLKESKSSLYSF

SEQ ID NO: 7803 - protein, 279 aa, Proteus mirabilis
FPYYYYHFQERCMSVPVLGLGTFRLKDDAVINSVKTALELGYRAIDTAQIYENEAAIGQAISESGISRDALYITTKIWVENLSKDKLIPSLKQSLSDLQTDYVDLTLVHWPSPNDAVSVKEFMQELLAAKQMGLTREIGISNFTIPLMEQAIAAVGVENIATNQIELSPYLQNHKVVNWAKQHGIHITSYMTLAYGKALKDETIQTIAKKHNATPAQIILAWAMNEGYSVIPSSTKRENLASNLLSVNIKLDSEDKQAIAKLDCHDRLVSPEGLAPHWD

SEQ ID NO: 7804 - protein, 77 aa, Proteus mirabilis
NKYYNKIAVSVKRKGQLAIDHAKRAPSGTGKLNSARTIAPFSSAAPVINTSDLIPAIRLIGKLQTHKTRRPISSSGV

SEQ ID NO: 7805 - protein, 192 aa, Proteus mirabilis
MENYIMINKVYYLKSDLENYSSFIQNYPDGEESIIGRAMDQRWSKFTDDYTAISLELNSNDFGRKNYKFDFSSFLSPFMVFSEDALVSLSDILSSRGQVLPVKTESKRKKFVGYYPTNSLSGCFDRKNSVYREYPNGLMIEKPVLIKNNITDEYLFTIDEYISRIFVTDKFKQRVEDAGLTAFDFSVEIELS

SEQ ID NO: 7806 - protein, 85 aa, Proteus mirabilis
PWSYSMNKTTLKIACYEIEDVTLKHSSDNQLTYVHIPCDYDKEFCMQLDGWDENTSIPAQLKDKNILLYRHAYDKENHHWILKVA

SEQ ID NO: 7807 - protein, 209 aa, Proteus mirabilis
IGIYIMYEITQFIVSDNKNVDSGLIIGGNKAYVSKWPINPKGKELLHLFSIDCEKVTPQIADGILPKTGYLSIFSTYDSNDYFLDEITYFGDENELGLIKSGFTFVSYSLTGSLSKTNEDFIPETKIDLLNTKINSEDYPMISFFSKDIPNGLTGVDEILKNYHFVCQVYSADFPLPFKDVLGLSDAIGYLFIKNEGNNIEGLFFVQTA

SEQ ID NO: 7808 - protein, 173 aa, Proteus mirabilis
AIKYFVCMVCILLSIIKDLPCSRLKEKIAEQISPPQRSAFTADLYPALAREQGFDGIDLPQPTIAGVAMDSIDSYVPSFKGEQVYGVPESQASWYASQMFIGNNMCAVIAKHWLVDKACNMPARDAIRQGYDIDCDNDDDRAISKKHRKRDKNTALHISLKSRFTLGMYTVIV

SEQ ID NO: 7809 - protein, 215 aa, Proteus mirabilis
DKKYFLWFGELMSILPEQRKAHLLSRVAEYGKLSKKSQFGGYSLMVDEVIFAITADNEFYLKGSGFVETLYKANNMDAYVYLKKGIPITLRYYRITQAIWHNSAKLNQYIDFAYHYSTQEFLGQQKQPRRIKDLPNLGIALEKKLNQVGINRIEELRTIGAKACYLKLIAQPKQGNSDLLLALAGAIVGCHRSVLPSQLKMELLNWYKELSVKSY

SEQ ID NO: 7810 - protein, 106 aa, Proteus mirabilis
QMKYYIDEHGYSCAEVETEHHLIAWFLKDDIQGSLNGVNEYLELCELVKNGELPEWEGTGNAHTVTIKPGGVEIFNEYTEESVTISTIEEFKGYLEKWKELLLSRE

SEQ ID NO: 7811 - protein, 504 aa, Proteus mirabilis
EYEYNRGMIMSEQQTDTAKSGAVRTLRRELKARHLAMIAIGGSIGTGLFVASGATVAQAGPGGALLSYALIGLMVYFLMTSLGELAAFMPVSGSFSTYGSKYVDEGFGFALGWNYWYNWAVTIAVDLVAAQLVMLYWFPDVDGWIWSALFLAVIFLLNYISVKGFGEAEYWFSLIKVSTVIIFIAVGIAMITGIMKGAENAGWHNWEIGDAPFAGGFAAMIGVAMIVGFSFQGTELIGIAAGESKDPAKNIPKAVRKVFWRILLFYILAILIISLIIPYTDPNLLRNDVGDISVSPFTLVFKNAGLLSAAAIMNAVILTAVLSAGNSGMYASTRMLFTLAREGKAPKFFGKLSKNGVPRNALYATTVVAGLCFLSSMYGNQTVYLWLLNTSGMTGFIAWLGIAISHYRFRRGYVAQGRDLNELPYRSGFFPVGPIFAFILCLIITLGQNYQAFLEDTIDWYGVVATYIGIPLFLLIWFTYKIVKKTRFIRYSEMQFPEHIENKK

SEQ ID NO: 7812 - protein, 418 aa, Proteus mirabilis
MSDLVTKESKSIHCQECDHLVSLPTDLKRGEDAYCPQCQAKLATYRDWSLTRLLILSITMLIFASIAFTQPLIKIHLLGTMISANVLDGIRLMSQQGSPLTATMVAFCAVAAPLSLPIAILYLHLGARLHLNLRPVLLMLGKLKEWVMLDVYLIGLGVATIKLGDYATIYIGHGLVAFSALMVLSLLMLININMDQLWQQFYPQKEIKTSPATCHACHYHFKKPPSSHCPRCKSCYSARQPMSLQKTWAALITAMILLLPANLLPISIFYLNGQRNEDTIFSGVLSLINSGNTPIAIIVFIASIFVPFFKIIIMLGLLLSIHFNSRIHPLLRMKLYRFVSWIGRWSMLDLFVIALMMSLINRDQLMTFTMGPAAFYFGTAVILTILAVEWFDSRLLWDTYATRRKQHTGNPSRNTSQT

SEQ ID NO: 7813 - protein, 150 aa, Proteus mirabilis
STWYYPYILYGEFMITKEIFVDIHVRFTQGQSIQKIARELGISRNTVKHHLQQEPMPTYTRRAPKQTKLVPFEPYLIQHIQLAKPDWIPATILFDELCQRGYQGAGLRNCVVSFTSLNPLLHLSRLCVLKRLSVSRCRLISPLFAEVNRS

SEQ ID NO: 7814 - protein, 308 aa, Proteus mirabilis
VIIHSFLRSIMKATSEEVQVFIAVVESGSFTRAAEKLALANSAVSRTVKKLESKLGVNLLNRTTRQLSLTEEGEHYFHRMQVILQDMKLAEDELINTQKTPQGLLRIDAATPVVLHLLVPFIKQFQQKYPQITLSLVSSETFINLIERKVDIAIRVGNLTDSSLRAKPLLNSYRKIVATPDYLARYGQPKIAEDLLDHTCLTFTEPVSLNTWPIERENGQLLEAPMGISSNSGETIRQLCLEGNGIACLSDFMVVNDIENGRFIELFPDKLQPIAMPFNAVYYSEKVVSQRIRVFIDSLSEYIAKKVG

SEQ ID NO: 7815 - protein, 168 aa, Proteus mirabilis
GITHMKIPTLLKHGLIATLTFMVSLNSFADPGNGKGNGNGNPHSHQNQRGNNGFNKGHQNVNQQDGFSSQLRIDSRGGLSVSITYDDARALAIKNNLTGYKGLPPGIAKNLTRGKPLPPGIAKKAVPSIMLSQLPHYDGYEWQIVGNDLVLIAITTSIIASVINNVFD

SEQ ID NO: 7816 - protein, 151 aa, Proteus mirabilis
ECAHIGRALYGDEIMLYPAFIEIDEDGSASGWFPDIDGCIFAGDSIEEAHADARSAIDAHFELLSEKGLDIPSPKSQQEHLINSSGDYNNGIWLLVDVDMDKYDGRAERINITLPHRLLSRIDTIVKTNPEYGSRSGFIATATRKELQKNI

SEQ ID NO: 7817 - protein, 125 aa, Proteus mirabilis
GNYQLAGNYALVGASYTKAESDGKYQPKGNYVPVGSSYTKNESDNRYKKLGNLKQFKKTASTVNADKTIVKFESNMIGKQLFATASDNRAYPVTVLPPPYQSLILWYGGNQFWGTTVTTLVTVKH

SEQ ID NO: 7818 - protein, 248 aa, Proteus mirabilis
LRDLMGFDGKIALVTGASRGIGRAIAEKLIACGATVIGTATSENGAKAISEYLGNRGKGFVLNVTETDSIEKFLADVRAEFGEIDILVNNAGITRDNLLMRMKDDEWQDIIDTNLSSVFRLSKAVMRAMMKKRYGRIITIGSVVGTMGNAGQANYAAAKAGVIGFSKSLAREVASRGITVNVVAPGFIETDMTRALTEDQRAGILSQVPANRLGNAKEIASAVAFLASDEAGYITGETLHVNGGMYMV

SEQ ID NO: 7819 - protein, 1178 aa, Proteus mirabilis
RVSHNMKRMLINATQQEELRVALVDGQRLYDLDIESPGHEQKKANIYKGKITRIEPSLEAAFVDYGAERHGFLPIKEIAREYFPSNYHSHGRPNIKDVLKEGQEVIVQVDKEERGNKGAALTTFISLAGSYLVLMPNNPRAGGISRRIEGEDRTELKEALSSLDIPDGMGLIVRTAGVGKSAEALQQDLSYRLRHWDAIKKAAESRPAPFLIHQESNVIVRAFRDYLRPDIGEILIDNAKVVEMARSHIEAIGRGDFASKIRHYTGAVPLFSHYQIESQIESAFQREVRLPSGGALVIDTTEALTAIDINSSRSTRGGDIEETAFNTNLEAADEIARQLRLRDLGGLIVIDFIDMTPVRHQREVENRMREAVRQDRARIQIGRISRFGLLEMSRQRLSPSLGESSHHVCPRCLGTGTIRDNESLSLSVLRLIEEEALKENTHEVHAIVPVQIASYLLNEKRKAVTDIELRQANVKVVIVPNDQMQTPHFSVIRVRKGEEISSLSYNLAQYHETQLNEAEDEAVPERKAPEQPAISAFALQDNSADTTNKKKSAPTPAKQVKKSETTENGGFFSAITKFFSNLFASQPEPVVEEKPQESKKENNENRRERRNNNNRRNNNRRERDNDRNRDHERNRDNVTSEENRKNRNQKAQNANTEVSNEQEIAEREARRQQRREQRAEQRRRQEEKRQQQQEAAKAAQNTAENDNAAKQAEKKEEPRRPVMPRRARRQLTQSVRVTDAAATPVIDVAVSDSPVSEPPATVVSQLPSSEKQQVAKPVATVKDEQEQVSANALTDTVKAQEEVKKEENAGQQENVMPRRSRRSPRHLRVSGQRRRRYRDERTLVSPMPLTMAVASPELASGKVCIHYPVTPISDAPFVDNNVENSTDNTVAKNFITHKDPQMVAIAPEVSETIAADVAQAQTANTEATEATYSVTVSTESTTEAVAEIVAIAPQETTADVNESTADHVEENAVNNVIADVNTQEHVTRKENISAVLNTTEAYLHEVTEQADVAEEKTETAHNKVIANADHETASEDTHSDMTTQAPVPEMPATTQASTECAAEQHVEQTASQSTPVETQPEVTEPVAETKTETEVASVEVKQPAKVTVIRQEPTVRQLHASSPMTKAPASTDAPVAIEIKAWDARPAFDKQGRSGAGGHCSTNHASSEMTKASTHSES

SEQ ID NO: 7820 - protein, 115 aa, Proteus mirabilis
FPGHEDSFPRSKSIMRVAILRINDRSWEIKTMLPWKSFKNFSNHKIVSISRWLVGSSKKSTFGALTNARPNAAFLNHPPESEESSASPFNPNFSNTSAIRLSNNQRLRLSSTSCN

SEQ ID NO: 7821 - protein, 249 aa, Proteus mirabilis
EPLHSMYSVYQFFQAIGLGLILLLPLTNPLTTVALWLGLSGNMTKEQRNQQSFMACVYIFIIMTIAFYAGRVIMTTFGISIPGLRIAGGMIVAFIGFSMLFPHTPNVDDPLSEEKNPHRNPQAPNIAFVPLAMPSTAGPGTIAMIISTAASIPSRTDIAQWVLYVAPITTFFLISLIVWLSLRGSTGIMRYLGHSGIDAISRVMGFLLICMGVQFMINGVLEIIADLPALLQQAQSAAAASLSEKLSAK

SEQ ID NO: 7822 - protein, 168 aa, Proteus mirabilis
NMLHQDMINKLNEQLNLEFYSANLYLQMSAWCDDKGFDGAAKFLKAHSREEMEHMQRLFDYLSDTGAMPLLGTIEAPPAEFLSLSDLFTKTYEHEKFITAEINKLAHLAMTTQDYSTFNFLQWYVAEQHEEEKLFKSILDKLAMVGDGGKALFLLDKDLSALSTSAHI

SEQ ID NO: 7823 - protein, 102 aa, Proteus mirabilis
IMAQLTTIFTMTELCHHTGVSKEELQEIVELGVIEPVEITTQEWFFNDDAVVVVHRALKLHRELALDWHGIAIALTLLDENERLKQDNKQLRQQLMRFINNE

SEQ ID NO: 7824 - protein, 160 aa, Proteus mirabilis
PLGLNWNLKACRRFILPIILWCMKNETNIRRGRHCVFLMHVHLVFVTKYRRKIFDQDAIEKLRGYFASVCADFDVELVEMDGERDHVHLLINYPPKLAISNLVNSLKGVSSRLLRRDRPDIAQHYYYKGVLWSPSYFAGSCGGAPISIIRQYIEQQETPS

SEQ ID NO: 7825 - protein, 84 aa, Proteus mirabilis
NYQQSMLFINRRNQVRYILLLFISLFFIVIFLLKTQGSTKSDVINQPTEIERKLNKKVERCMFHSKIKTKRLPWIMLTRKRSCS

SEQ ID NO: 7826 - protein, 134 aa, Proteus mirabilis
KDKQDVYMQKISKLMEAWGSWVVNNNLYINTLTINKRENVPIRVKLRKACTDRQGIIVSVCMSKLLKNHKKDYELLVDYYVFGQTFIQLAQAHRCSDTYIGKKLKKAEGIVEGMLIMAELIFIIEKNENSTLRS

SEQ ID NO: 7827 - protein, 153 aa, Proteus mirabilis
QMEQIDRTLATEKNIALVAHDHCKSSLLEWVKNNSEQLSHHKLFATGTTGNLVNHHTGLEVTQMLSGPMGGDQQIGAMIAEKKIDILIFFWDPLNAVPHDPDVKALLRLATVWNIPVATNRATANFLISSPLFSQESKIKIPDYEGYLKERLK

SEQ ID NO: 7828 - protein, 192 aa, Proteus mirabilis
YPMQFYFDYELTMSSIKSPIIISITSIAGGGKTALSHYIREKLPSSKCLHFDDFDCPTAPEDLDEWIEQGGNYSEWDIKPFVEQVNQTIEESQYTHIILDYPFARSHPALQQMIDYAFFIDTPLDIALARRILRDYKEKSGNDIIHYLEEYLIYSRPSYTAMTEREKLSADIIIDGNASVSLIAQNILKYIV

SEQ ID NO: 7829 - protein, 63 aa, Proteus mirabilis
YIPHLISPVYKKHGLLIILYTKLSTCIVINKNNYIFINNLKVILITFFVSQYNINNGVILSID

SEQ ID NO: 7830 - protein, 124 aa, Proteus mirabilis
DKKQQNTGNNKGEAMKRIIIPTNYIHIRTTPFWTRETAPKSIWERHLDKGTQQGVYPRLSVMQGTIIYYAYADQYSPKPTETLVIKEGEFGVFPPETWHRIEAQTEDTVFNIDFYVDPKILAEG

SEQ ID NO: 7831 - protein, 65 aa, Proteus mirabilis
SVEQIMQNKKKIRTVYLLFICDKDKRYFLLSESFTLPLGTQLHASILPERFMAPAFNALTSPSSN

SEQ ID NO: 7832 - protein, 291 aa, Proteus mirabilis
SMWQNIGRLLESNLGFSAKISEKHHLSSGDIHHTWKIQYGEIPVFVKSNLREFLPTFKNEAEQLEMLAKSQTIRIPRVLGIGNSKDTSFLLLEFLPVQPFTPHSAYCFGQQLAKLHQWEEQPRYGFDFDTHIDTTPQANGWEKRWNYFYSEKRIGIQLQLASEKGMVFGDIEEIIQIINHRLADHHPQPSLLHGNLWPKNCAAIGQSEGTMFDPACYWGDRECDIAMLPLCSSVPANIFDGYQSIWPLSEKFLSRQPIYQLYYFLNRCHLFGEEKDYLAARKIIDDLLGTH

SEQ ID NO: 7833 - protein, 212 aa, Proteus mirabilis
NVGHHFATDFIKNMLPLVLASTSPFRAQLLKKLGMPFIQASPNIDETPLPTECAQALVTRLSYEKARALEVQYPNHLIIGSDQVCVLNKKITGKPLNFENAFAQLKQASGQCVSFYTGLTLYNSSTLAYESHCELFQVHFRHLTDDEIIGYLNKETPFYCAGSFKSEGLGITLFDKLSGDDPNSLIGLPLIRLNKMLLSQRINPLLSTDNQE

SEQ ID NO: 7834 - protein, 80 aa, Proteus mirabilis
FHFKFNLVNNYLNLFIFNKLNKVLFLYLAKSNARLNCINLSQIAIFLASIMLGSHLTTLLFTFLSNKILKQIINNLPSSH

SEQ ID NO: 7835 - protein, 67 aa, Proteus mirabilis
LKLKRSLLSDERTNLVYAKKSFSLHLLHPKYFLTWLGGLILFLLVQLPYTWLLFLRKHLRLLSRFFI

SEQ ID NO: 7836 - protein, 459 aa, Proteus mirabilis
IVINQVEFKMKLKRMVLFMFSPCFLAVSAANAGNWENTIKESSFISDSELELTTINMWKYLKTENRFDKQEQRYRKQVANAWGQNFQADFRSGYLGGILGFDVSYYGGIKLGASKDFASRAILYNDDGEAKGYNKIGQRFAKVRFDLDPVLINGKAGWFTLKNTGIFTNSQRLSLNSYNGYYTNTAMGDWSLDLLYLDGKVMRRDSPNIDRMYFSDGNGVRHNIDHVITGGVNYNSKPLKVYYFYGQADDVFRQHGLETKYKLTSDVTLGGVVYYHDYGSEGKRTLTNANAGKRNFDKDAWHFAGTMEWRIPESAWTIRTGVTYTDAKKANGVGQFARNPIGNTRGRFNSPAYADIDYVRDGEVMGALEAAYKVNNELSVGARTNYSEFSYSGERLKQGQFGLFSYWKPTANLSISLSGGIGWHHQQENDYTTPKLYDGHSRRAHSLSGSMTTTYRFKM

SEQ ID NO: 7837 - protein, 390 aa, Proteus mirabilis
KNNKTFLGALMINVSRLYIHPVKSMKGTRLSQAFARESGFTFDRDFMITTPEGTFITARKYPLLLCFIPTVMTNGIYIQAPDGEGIAITYQDFQSSLQPTEVWGNHFTAYVAPDEINQWFSRYLGMDVQLRWTGEKSTRRVKKSPETAVSFADGYPYLLINEASFQSLQQRCPASINIEQFRGNIIITGAKPFAEDSWQTIRIGSVVMDLVKPCSRCIMTTISIDKGIKHPTTEPLATLQTFRTDEKGDVDFGQNIIIRQSGIIRVGDKVEILAYKEAKSYLQTTEQTTEPATDNAVTAASAQEPKQAVTIEFNGISFAGNNQEVLLEQLENHGYAIPYSCRAGICGSCVIQLDEGDVNALKAGAIKRSGRILACSCVPKGNVKLSLNKK

SEQ ID NO: 7838 - protein, 358 aa, Proteus mirabilis
IINNKQMRHYMFLFKKAVIALSINIALVSSALACTTLLAGSEATNDGSLIVARSADSDALKAQHFVIHPAKNNQTGIYSTQAHHGANNFTYPLPKHSLRYTTVPNWKTQLHGATGFNELGVGVSGTESIFASPKALAFDPYVEDTGITEDDIPDILLSRAKTAREAIELLGNIIETQGAGEGFGVAVVDKNEVWYLETGTGHQWMAQKLPKDKYFATGNQGRLQAYHIDSNDTLGSKNLVEFAIEKGLYDPATDGEFNFSKAYTRDDERDLTYNYPRVWVIQQQFNPSLKQNVADGRQFAPMLTPEKKVSVEDAKAMLRNHFDGTEHDPYTNGLNGNEPWRPISVFRTYESHVMQVRP

SEQ ID NO: 7839 - protein, 103 aa, Proteus mirabilis
KRDNFSGVNCVGSPIRWQYSSVTKTVDLIGVAETTWANCGRGNIHFQATNKRIANTRISPISVNFLLSTLTFSPFYAFIPILLFFCYKRISLFYHHVVIQYVE

SEQ ID NO: 7840 - protein, 113 aa, Proteus mirabilis
EMDNASKPSFQNVLEFVRMYRRKNKIRREITDNEKKIRDNQKRVLLLDNLSEYIKPGMSIEDVLGIIANMRSDYEDRVDDYIIKNADLSKERRELSKQLKAMGEIKNIPNIKN

SEQ ID NO: 7841 - protein, 80 aa, Proteus mirabilis
GLYNISVDVYIAPHCGGVAERLKAAVLKTADGKPSESSNLSSSAISTYPSVSLTSFDPLKNFLVNSFIHNYSNFCLYKEY

SEQ ID NO: 7842 - protein, 726 aa, Proteus mirabilis
LYDNVIQLAIMPNNFILGGNNIMRSLFASTGRGLEELLKTELEHLGAQSCQITQGGVYFRADDKTMYQSLLWSRLASRIMLPLNEFNVYSDLDLYLGVQAIDWSEVFTVNHTFAIHFNGTNDVIRNSQYGALKAKDAIVDSFQRKIGQRPDVAKQSPDIRLTIHLHKEKASLSLDLSGDGLHQRGYRDLTGQAPLKENLAAAIIMRSGWRTDTPLIDPMCGSGTLLIEAAMMATDCAPALNRVHWGFRHWLGHNEALWKEVTHEAFARFREGKKNTQARFYGFDVDKRVLDMARANARRADVADLITFTQGDAAKLTNPVSTGVKGTIISNPPYGERLESEPALIALHSQLGRAVKAHFPGWRLSLFSASPELLSCIQLRAEREFKAKNGPLDCVQKNYLLSETPSTINTRLAEDFANRLRKNEKKLAKWAKQQQIECYRLYDADLPEYNVAVDRYGEKVVIQEYAPPKTINEHKARQRLFDVISATMEVLALRSDQLILKTRQRQKGKQQYEKMAEKGDFFLVDEFGAKFWVNLTDYLDTGLFLDHRIARKMLGEMSKGKDFLNLFAYTGSASVHAGLGGAKSTTTVDMSRTYLEWAEKNFQANGLSGRQHRLMQADCLQWLSQSNEQFDVIFIDPPTFSNSKRMENTFDVQRDHIELMKHLKRLLRKGGTIMFSNNKRGFKMDHEALANIGLTAKEITQKTLSQDFARNRQIHNCWLLNHAGEE

SEQ ID NO: 7843 - protein, 87 aa, Proteus mirabilis
PLCFRKTMRPIFLLIPFMFLIGCTEQMSVGIGTSRTHNIGYPVCSTLVCGKNTRTVEEQKAINEAVHEQQRAIMRGEKPDLKIIASY

SEQ ID NO: 7844 - protein, 127 aa, Proteus mirabilis
RHSNKIIGSKMTDTTNTNTIEWDDFLRVEMRVGTIISAEINKKAKKPAYVMEVSLGELGTKRSSAQITVNYTPEELIGRRVLCVCNFPIKRIAGIKSEVLITGAADENGAIVLAEFNLPVPDGARLA

SEQ ID NO: 7845 - protein, 417 aa, Proteus mirabilis
MESKVVVPANGAKITLDAKGKLVVPNNPVIPYIEGDGIGIDVTPAMLKVVDAAVEKAYGNERKIEWMEVYTGEKSTQIYGKDVWLPEETLDLIREYRVSIKGPLTTPVGGGIRSLNVALRQQLDLYVCLRPVRYYKGTPSPVKHPELTDMVIFRENSEDIYAGIEWKAGSAEADKVIKFLQDEMGVTKIRFPQDCGIGIKPCSEEGTKRLVRAAIEYAIDNDRDSVTLVHKGNIMKFTEGAFKDWGYELAREEFGGELLDGGPWVKIKNPKSGKDIIVKDVIADAFLQQILLRPAEYDVIACMNLNGDYISDALAAQVGGIGIAPGANIGDECALFEATHGTAPKYAGQDKVNPGSIILSAEMMLRHMGWTEAADLIIKGMEGAIEAKTVTYDFERLMDGAKLLKCSEFGDAIIKHM

SEQ ID NO: 7846 - protein, 192 aa, Proteus mirabilis
VKGKRVVIVHGYTASPKDNWFPWLKEELGSLGYDVSIPMMPEPNHPNPNEWQQKLADENIILDKDTILVGHSLGCITLLRFLSEQACEDITIGGYILVAGFNSEQKTLPELNSHIYNNLNYSKLIKISDKRVSLISSNDWIVSPDSSKKLASQLQTQVVIEEDAGHFLDKEGYIKLPVMLDIFKYMLNQYKL

SEQ ID NO: 7847 - protein, 265 aa, Proteus mirabilis
VNIKEINMDKITIKTPEEIELMRESGRLLAQVFTMLDDFIVPGVSTLEINDKVDDFITHDLQSRPASKGQYGYEYVLNTSINEVVCHGVPKADELLKSKDIINVDITLEKNGFIADSSKMYVMPDASPIARRLVKTTYQAMWEGIKEVKPGATLGDIGHAIQSFAQSHGYSVVREYCGHGIGREMHEAPQVLHYGIRGQGVVLKEGMTFTIEPMINQGGHKIKTKKDGWTVVTRDKKLSAQSEHTILVTADGYEVLTLRPEETLP

SEQ ID NO: 7848 - protein, 218 aa, Proteus mirabilis
IYINFESNFQKIDLDLSETQVYCIYIQYILNEVNMKLSTSSLARQNGLFQEISTEVLPLFMASDAITTTMPDNRQGMVSELLYQNPLMINHILLPLLKQYSHESRWLLWLSPQQKLNRSWLKETGLPLNKIIQLNHVDSINTVELMEKALLSGNYSVVLGWLPEISSEEMKRLEYAASIGKALGFIMRQQNSNHIQIENNNSSKRHLNSIKIHSNHYH

SEQ ID NO: 7849 - protein, 605 aa, Proteus mirabilis
TVINRKIRQDRNRIGTMNESSSSTNQHFIRKLEGIVGKKHVLTQEHKTERYRKGFRSGQGKALAVVFPGSLLEQWRIFKTCVEADKIIIMQAANTGLTEGSTPSGDDYDRDIVIISTLRQDKIQVLSEYNQVIAFPGSTLWHLEKVLKPLGREPHSVIGSSCIGASVIGGICNNSGGALVRRGPAYTELSLYARVNEQGEAELINHLGIDLGDTPEEILTNLDNRHYHAKQIHATDKLASDHEYSERVRDIDADTPSRFNNDERRLFEAAGSAGKLSVFAVRLDTFPADHRTQVFYIGTNDPDELEDIRRHILSQFKVLPVAGEYMHRSYYKMAEVYGKDTFLIIDKLGTDKMPALFAIKGRVDAVLNKVPFLPKNLTDRTMQLMSKLWPAHLPARMTEYRDKYEHHLMLRMADSGIEEASTYLKEYFKHATGDYFECTEEEGNKAFLHRFAAAGAAVRYHAVHINDVEDVLPLDIALRRNDRDWFEKLPPEIENQLLYKLYCGHFMCHVMHQDYIIKKGVDAKALKAQMLALLDKRGAEYPAEHNVGHLYYAKPQLKAFYKHNDPTNSMNPGIGKTSKLKYWGEECGCGHNHNQAEVNHIENKE

SEQ ID NO: 7850 - protein, 340 aa, Proteus mirabilis
MKIKKLVWIAFFALLISAGAATLYIMQSLRGLENNVVVKQDEMLLTVPAGTGRIAMEQLLIKNNLLKQGDYFQILLKVKPELSQFKAGTYRLTKGMTLRDVLLLIKSGKEAQFTIRFIEGSRLSDWQAIFDKAPELKIVANGMESDKLRQEIGMKPEITHLEGWFAPDTYHYTAGTTDIAILKRAYQQMEKTLEEEWLKRDSDLPYKSAYEMLIMASIIEKETGIDAERTKVASVFVNRLKRNMRLQTDPTVIYGLGDKYRGTIYRSDLNGYTPYNTYQIDGLPPTPIAMPSVASIKAAAHPADTRYLYFVADGTGGHKFSTTLAEHNKAVAQYRRLQQR

SEQ ID NO: 7851 - protein, 68 aa, Proteus mirabilis
SISLLLLSLLLLRRNIMVKPTMSLRSQHVKNLAKKIKKMRAIEKAINCNKEADLLVIINKNPTLVFIK

SEQ ID NO: 7852 - protein, 202 aa, Proteus mirabilis
TLSKGISRCRIAQLRRFVYQFKPIIAPEPIVRFETPLGQQMQIDFTTIRRSKQKLKAFVATLGYSRACYVKFFDNERASTWQQGLKEAFDYFGGVLQQVLCDNAKALIVKRDAYAKGEHKLHVEMLQMSKNYSFKLTACQPYRAKTKDKVERFNHYLKNSFIVPFKAELRAQNLELDVEIANAKIGPWLQRKWGVGKNVLLK

SEQ ID NO: 7853 - protein, 139 aa, Proteus mirabilis
REKNLMLELIKKKYPTAICWSFGDNPQLADELAQLVVERKKTATCSSLSGFFSDPVTPTIGGYNIILNSHGVPICVIRTRSLTLVRFSEVTEQLARKEGEGDLSLSYWQQGHKEFFMREGTYSPDMELIFEEFELIEVF

SEQ ID NO: 7854 - protein, 201 aa, Proteus mirabilis
SLEKSESNADPITGAMAGARMIIYLHGFDSTSPGNHEKVLQLQFIDPDVRFLSYSTLHPRHDMQHLLKETDKLIKSTKQPVLICGVGLGGYWAERIGFLSNIRQVMINPNLFPYENMTDKIDRPEEYLDIATKCIQDFRSKNRDNALVILSRHDEILDNQRSADELSPYYSIIWDETQTHKFKSLSEHLFKIKAFNSKIPA

SEQ ID NO: 7855 - protein, 116 aa, Proteus mirabilis
FVENVQLSVVHKLPLSYRWLAGFTGTRVEILPENDASRQNTLIGLKLLSHDGMTLDEAIQNLQKYLNNLNIENVIIEWDGVPCLFLHSDDECAALCCLKNAGVAIAEPFPTDYSYL

SEQ ID NO: 7856 - protein, 170 aa, Proteus mirabilis
KGEKVSVDSKKFTLIGLILVLAILLFVAWKWIFPRPQFAHVVSATPIKSTVFVTEEYCHRIGLPTQFTPEKLSRFHPAEQECRVFYMIEALNNKSIAHFPYAQFRECIPIYRQERRVIGYDVLYTIDGTPGKVRTTFKPGDIIALDSDGRLVLEQEPYCSMNENIPCRKE

SEQ ID NO: 7857 - protein, 75 aa, Proteus mirabilis
IKGNSMSNSMTGTVKWFDEGKGFGFITPADGSKDVFVHFSAIQSDNFKTLAEGQQVSFTMENGMKGPAAGNVVAL

SEQ ID NO: 7858 - protein, 279 aa, Proteus mirabilis
IRCLMYWVNGQQQQSINVSDRAVQFGDGCFTTLAVEQGKPILLSAHLKRLQRGCDALFLPSPDWQWLASHLLQIASTITEKSVIKVIISRGSGGRGYSSKGFDTPTVITSCSTYPFYYHNLQKQGVSLAISPVRLGQNSLLAGIKHLNRLEQVLIKHHLETTPFDDMLVCDNEGYLVEANAANLFWRKGNQLFTPDISLSGVNGIMRQQVLDFAQQLDWDIHIVREKPQTLYQADEIWLTNALMPIIPVKQIYFSDDKHYQYRDRDAYHVVLQHCLSLT

SEQ ID NO: 7859 - protein, 73 aa, Proteus mirabilis
RITLKKPENPYGLPVLFLFGAAQFLFLVAVVIDKQLPHSQLNFTKLVLLALVLLLDGSGVISIRMIRVYWSAL

SEQ ID NO: 7860 - protein, 330 aa, Proteus mirabilis
RIMNWYPWLNQAYRQLVSMYQEGRGHHAILLHASQGMGADALSYGLSRWLMCQNKQGSKSCNECHSCRLMLAETHPDWHILQNEKGKSSIGIEAVRKVTEKLEHHAQQGGSRVVWIKEVEALTEAAANALLKTLEEPPVNCYFLLNCQQPEILLATLRSRCFYYHLAPPEMNYAIHWLQQQLPNMAYADGVTALNLSQGAPVLALSLLKQEWQEREAFCQALYVSLQQRNLYGLLAQFNQDNAERKIYWLLSLLLDALKRQTHAEVYCVNQDKQPLIMALSQLPSAMLLAVSESWKQCRHQLVTIPAINKELLLAEQLLDWEAQLVALGK

SEQ ID NO: 7861 - protein, 192 aa, Proteus mirabilis
KIMKYIIGIAVLMLTACSSVPDKAYYQLPDVYQGANNKVVTTTESAKQDQIWIQPIRLSDMLVNTGIVYQTSDINYTVANQHLWINPLDQQLQQNLVVGLAKEFPNRVVSTQPIEDKLAKLTVNVNYFQGRYDGKVIIAGDWIYTQGNKVISQPFSVALTQTEDGYPALVRTLGEGWQNVVAEIAKTIKSQY

SEQ ID NO: 7862 - protein, 217 aa, Proteus mirabilis
QGVNMTIETIISVLKEYLAKLNDEQKIEALNKIKISLHQISPFKNEPTDCVLWIKQQQVIANDYNPNVMSPTEKRLLETSLVKDGYTQPVVVLPIQQSKNKPSQWQVVDGYHRYLLSKKNSLNKRINGYLPITILDVESHTMADQMAATIRHNRARGQHQVAAMSDIVRDLSRLGWNDQKIGDELGMSQDEVLRLKQISGLAELFSEHDFSEAWTVK

SEQ ID NO: 7863 - protein, 63 aa, Proteus mirabilis
KRVNNNLITNHSYYIIYTLIALKYYFYIFIVSFSQAISDILSDTLFIINKAHKLLSKLFIILL

SEQ ID NO: 7864 - protein, 404 aa, Proteus mirabilis
HTKNNCENIPILVLVVIIIKIMNLINNSICYMLMQNLHKQGFSMSEQSQTTTLAKKCFIPVYRWLPGLLLTGILTALAIYVGDIPWFSSMGLGALTLAILFGIIAGNTVYPIAKPYSDEGVKFAKHYLLRAGIILYGFRLTFQQIADVGATGLIIDAIMLTSTFLIAMWVGKKYFGLDDQTVMLIGAGSSICGAAAVMATEPVVKAQASQVAVAVSTVVIFGTIGIFLYPWFFHLNAFAGWLPFSEETFGIFAGSTIHEVAQVVAVGHSISPDAENAAVISKMIRVMMLAPFLIILSTYISKKGRKTVGATTEKSPITIPWFAVFFILMAGFNSFNLIPAAIVSYIVTIDTILLAMAMVALGLTTHISAIRQAGVKPLLLALFLFFWLTLGGAAINIFIQSVLM

SEQ ID NO: 7865 - protein, 61 aa, Proteus mirabilis
WLWKKNSISKSQTKKQKKLLQFKLLLITLKTQVNKLANLGGHSTAYILNPKLFPSLEDKRV

SEQ ID NO: 7866 - protein, 224 aa, Proteus mirabilis
RLRNGRMKEIEQFYRELESAINFILEDKEYYDFIDNALVDYIENATNKFIYEWNDDFFEKKCKITLNINALLNEKSSTIVLLLRDFLMEEKDNYIELINYFYFSVLECYCEEYFGNKIEKNLNELIAVYFITLSYFSLDDQIVVFKSLIKNIKANNEFIDDELSETLIPLVFYLSKEKLNSVNDNLNNDIEWGIKEFDFNLKYKKFVDGFFHKEDIRSLLNEFL

SEQ ID NO: 7867 - protein, 178 aa, Proteus mirabilis
RNYLFSSDINRVMLASWPENGNVVISSLLWPLIVCFLIFYFRKHLLKLIDTFFDGKLNIKISGFELNLKENSIQQGHIILDLQSKLVEMGKKIHTLHPNSEKILLPNIPMKKKVLWVDDNPSNNSYLIETLKINHIDVDTSLSTSDAIEKIKSNNFDVIISDMGRPEDDRAGITLTKK

SEQ ID NO: 7868 - protein, 322 aa, Proteus mirabilis
  UNSURE (208),(211): Identity of amino acid at the above locations are unknown.
NDIDNHYQLENSTKIIRLYNMDMFRSVNKISLTALCLVASIFFITPAQAKDKLKVVTTFTIIQDIAQNVAGDAAVVESITKPGAEIHDYQPTPKDIVKAQKADLILWNGLNLERWFERFFNELRNVPAVVVTEGITPMPIREGAYKNNPNPHAWMSPNNALIYIENIRKALVEHDPDNAAIYNQNAARYAEQIKQLDAPLRARLARIXEEXRWLVTSEGAFSYLTNDYGFKEVYLWPINAEEQGTPQQVKYVIDTVREHHIPVVFSESTISDKPAKQVSKETGAKYGGVLYVDSLSAPGGEVPTYIDLLNITVDTIAKGFGQ

SEQ ID NO: 7869 - protein, 173 aa, Proteus mirabilis
TMVDRRESYSKEDLIASGRGELFGQDGPPLPSGNMLMMDRIIKMTEDGGSHNKGFIEAEFDIKPDLWFFDCHFVNDPVMPGCLGLDAMWQLVGFYLGWLGGEGKGRALGVGEVKFTGQILPTAKKVTYKIDFKRVINRKLIMGIADGEVYVDGKLIYEAKDLKVGLFKDTSAF

SEQ ID NO: 7870 - protein, 896 aa, Proteus mirabilis
LNRFLTSKLWLYNRKIVVLTKRLFSMTQQRIAKYRKDYRAPDYTITDLHLDFILDKEKTQVTAISQCKRLATTVTPLVLDGDDLTLKSIFVNDVAWTHYKEENGKLIIDQLPEQFTLKIVNEINPSANTALEGLYVSGDALCTQCEAEGFRHITYYLDRPDVLARYTTTITADKKQYPYLLSNGNRVAQGDLEDGRHWVTWEDPHPKPSYLFALVAGDFDVLRDTFNTKSGREVALELFVDKGNLDRADWAMTSLKNAMKWDESRFNLEYDLDIYMIVAVDFFNMGAMENKGLNVFNSKYVLAKSETATDKDYLGIESVIGHEYFHNWTGNRITCRDWFQLSLKEGLTVFRDQEFSSDLGSRSVNRINNVRVMRTAQFAEDASPMAHPIRPDSVIEMNNFYTLTVYEKGAEVIRMIHTLLGEEKFQAGMQMYIHRHDGSAATCDDFVQAMEDASNVDLTLFRRWYSQSGTPVLTVRDSYDAQKQQYTLTVSQMTPPTADQAEKQVLHIPLDIELYNQQGEVIPLRSQGQPVSNVLNVVREEQQFIFDDVAQQPIPSLLREFSAPVKLDYPFTDEQLSFLMKHARNAFSRWDAAQSLLGRYIKENVSRVQKGQPLILPEMVIDAFRAVLLDKDIDPALAALILTLPTDVEAGEAFAIIDPIAIHQVLGFIRKTLATEMADEFSAVYHSMHIGAYRVDHGDIAKRDLRNVCLGYLAVENQQTGNQLVEAQYHNSDNMTDALAALNAAVMAQLPCKEALLQEFDDKWHQDGLVMDKWFSLQAMSPATDVLQTVRSLLSHRSFTLANPNRTRALIGAFVNNNPVAFHAEDGSGYLLLTEILTDLNSRNPQVASRLIEPFIRLKRYDANRQEKMRAELLKLKALDNLSGDLYEKITKALAD

SEQ ID NO: 7871 - protein, 62 aa, Proteus mirabilis
KEADMSTMKTEVVVIRLTKQERAALDSIKTMPLLADWLKELALSKWKEQALQLEQSKNGHSN

SEQ ID NO: 7872 - protein, 77 aa, Proteus mirabilis
WLYEKQSLSFRLNLEREGCLNMKRQKRDRLARALSKGYQAGMQGRSKEQCPYFAIDARSHWLGGWRQAMEDRPGLAK

SEQ ID NO: 7873 - protein, 173 aa, Proteus mirabilis
SKNEVMTLPSKELIGMAHQYNKNISALEFDKKKFRKEFWKKFLKEIHTIPTEMYATHRASAGSLDDTTYIYTTAVSKEQLTSSANISTMSKVELPNGKYLVITFEMDNILDSLTGYDDIIYTVYTKVLPKMNLLRRSGPDIERYTLKQSVSYDKLIGHSEQHLQEISYYIPVL

SEQ ID NO: 7874 - protein, 452 aa, Proteus mirabilis
SIDEGFNLFSIFIFNYLKIMKWLMQSYLKVILLFYNHLYIYIIFILMLEIHVNKRALSTKYRNSMYPSMIKKIGGYGLSLFLIPIIFFHSANALELSVPIGSTGYLGEVTPPVGSTTKNYGMVSSVLQANRSYISFRWEPSQFVISDLPFYPEIGRVGVAIYNKSNPKGAFIVLAPSGYGLLRYKRANDTYENASFSFSRSKTTAMTNMYNNFPSNSDELSWGLLPRQGNSNFFSARYVDGSDKVHSLTLTISSYSAYAIGPLEAGEYAMRDDSKFYAVIRTSSGSFARSKTLLSSMDNVNIKALKACDVIPQTSTNIQFPTQIAKNYATPTKLADNLASISVNCPYANKNIYLTLSPFNNLVSGSETGMELSTSSTENITTLPYVVASLKSAQSNICQANAQDALRLVGSNKLAQQNMKSFTQNILFNLCANGNIKANKYAGAINVAILIE

SEQ ID NO: 7875 - protein, 67 aa, Proteus mirabilis
RVDDDALHTSDLFSITNNTVVTLLCNKLFANNKANKNTYQCDCEYKLEFSLICVIISHRIEKEPAKL

SEQ ID NO: 7876 - protein, 111 aa, Proteus mirabilis
MTDELGKTRDSFIVKAWNLVISFIVGLSAFFILRLIILITLNLIATSNNVATIQTIGGIMVVLSIGIAAIYTKILNSSGTLESRKRKKIITVIVGGVSLYISTVLLHIPVF

SEQ ID NO: 7877 - protein, 181 aa, Proteus mirabilis
YARLMQKVKLPLTIDALRAAQKNLDYDGQYSSEQVSRLAESVVSVDSNIDVALSFDIDHQRLAVIKGHSDVDVTLECQRCGGHFPYHVHTTYCFSPVVSDERAEALPEEYEPIDVDDFGEIDLLAMIEDEIILNLPVVPVHDFEHCEVSDAEQVFGELPEELSEKPNPFAVLASLKKSTKE

SEQ ID NO: 7878 - protein, 555 aa, Proteus mirabilis
LRSLRVTEKNDTALTQAKINKLKSWSPVWIIPLVTLLIGAWILYYHFSHQGPEVTLITYNADGIEAGKTKIKSRSVDIGLVESVTLDSNFSRVIIKARLDNEMKELLRADTAFWVVKPQVGKEGVTGLGTLLSGAYIELQPGLTGKEQDEFNLLDSPPLASPDAKGIRINLVSERAGQLNAGDPVLFRGYQVGSVETSEFNIESRDMHYQLFIKAPYDKMVTSNVRFWKDSGIAFDMSSSGVRVEMASLSTLFSGGVSFDVPTGWLPGEAIAPKTEFKLYDNEKSIQNSLYTDYRSYIMFFSDSIRGLQAGAPVEFRGIRMGTVVQVPYYTQEMQQSLDKDFRIPVLIHVEPERFANDVGESFDFVKELSSAAENGLRASLKSGNLLTGALYIDLDFYQDVEPWKGPQTVAGLPQIPTVSSGLTQIQQKVMTSLDKINNLPVEPMLKEMTATLTESQKAVAEAKETLKSLNAMIGSDDFQKLPNDIQQSLKEINRSMQGFQPGSPAYSKMVDNMQRLDQVLREMQPLLKTLNNKSNALIFEAQQGKDPEPKRAEK

SEQ ID NO: 7879 - protein, 353 aa, Proteus mirabilis
IVVDISFLIPDILNGDRMYYSLVRKALFRLDPERAHDFTFRQLKRLSHSPFQFLIQQSLPAKPVSCMGLSFKNPLGLAAGLDKNGDCIDALGAMGFGFIEVGTVTPRAQVGNDKPRLFRLVEAEGLINRMGFNNLGVDNLIENVKQSQYGGVLGINIGKNKDTPVEQGKDDYLICMEKVYPYAGYIAINISSPNTPGLRTLQYGEALDDLLSAIKNKQLELQGKYQKYVPVAVKIAPDLTHEELIQVADSLVRHHIDGVIATNTTLDKSLVSGLDHCNEAGGLSGRPVQSKSTQIIRQLNEELKGALPIIGVGGIDSLTAAREKMDAGASLIQVYSGFIYHGPALIKSIINHI

SEQ ID NO: 7880 - protein, 78 aa, Proteus mirabilis
WKVDNMFPEYRDLIAKLRQTDPHFRALFEQHNELDHKIVRLEHRDRRGYGEEVVELKKQKLRLKEEIHQILKNPPEDE

SEQ ID NO: 7881 - protein, 150 aa, Proteus mirabilis
LPQEIGEVTLCWVWEWADLTAFVSYYSGLKAYPQHYAIGTDKADNDSIYWKYRKLQTLVMTDYPQFAPIVKKAYQEWEAKTALEQKEMEANYLSMSKKNKAAADNMLNEFNLRVMADAEQLTENLTNQLFTLKTKNIQDEIFFANQSKKD

SEQ ID NO: 7882 - protein, 78 aa, Proteus mirabilis
LSKETTSSDKVKKSDMDEAPQACAISCVVGICRQYGSPIRISPPVLILFASSSIVSITPPAIQVAPMHAAISHFLSLI

SEQ ID NO: 7883 - protein, 65 aa, Proteus mirabilis
FTEDKSTFLWKIPLFLCRKIIRLFVGMINQILDFTIPLLTHKTVSSLFNNSGNLVNISKTPIVDL

SEQ ID NO: 7884 - protein, 320 aa, Proteus mirabilis
HNRDITMELKDYYAIMGVKPTDDMKTIKTAYRRLAKKYHPDVSKEPDAEERFKEIAQAWEILGDEQRRAEYDELWAHRNDPKFKQFTQHNNSHSNQQSFSQEDFDDLYASFFGQGSPFEGRHSRQAPRQRGQDLEIELPVFLEEAQEEHKRTISYHLPVYNVFGMIEKEIPKTLNVKIPAGVVDGQRIRLKGQGTAGENGGENGDLWLTIRIAPHPLFDVKGHDLEIVVPIAPWEAALGTKIAIPTLKDKILLTIPPASQAGQRLRIKGKGLVSKQKSGDLYAILKVVMPPKVDEKTHSLWQQLAEAQADYNPRKNWENK

SEQ ID NO: 7885 - protein, 112 aa, Proteus mirabilis
IKREIIMDLKQCDKKQLKEEFNRLTALTSYKSTMGVFDIFTRLPELLNNDETVLCVNSGIVKSNIWLIIPTNKRIIFLHKKSGIFHKKVDLSSVNYDAITSIDSSSGLTGVK

SEQ ID NO: 7886 - protein, 472 aa, Proteus mirabilis
TKRDLFMIVAPVVDVLQGRIAVGEDVTVRGWVRTRRDSKAGISFLTVYDGSCFNPVQAIINNNLPNYQDEVLHLTTGCSVEVTGKIVESPGQGQNFEIHATKVVVVGMVDDPETYPMAAKRHSVEYLREVAHLRPRTNLIGAVARVRHTLAQALHRFFDEQGFFWVSTPLITAADTEGAGEMFRVSTLDMNNLPRTDKGEVDFSEDFFGREAFLTVSGQLNGETYASALSKVYTFGPTFRAENSNTSRHLAEFWMVEPEVAFADLNDIAGLAEKMLKYAFSAVLAERRDDMEFFAQRVDKEAITRLEHFIASDFAQIDYTDAITVLENCGQKFENPVYWGVDLSSEHERYLAEKHFKAPVVVKNYPKDIKAFYMRMNEDGKTVAAMDVLAPGIGEIIGGSQREERLEMFDKRLAEMGMNKEDYWWYRDLRRYGTVPHSGFGLGFERLVAYVTGVTNIREVIPFPRTPRNVDF

SEQ ID NO: 7887 - protein, 254 aa, Proteus mirabilis
QLKEIKMDIPRIFTISESEHRIHNPFTPEKYATLGRVLRMKENWQILDLGSGSGEMLCTWAHDYNITGIGIDISPLFTLQAKSRAEELGVSHRVHFIHHDASDYISDKKCDIAACIGATWIAGGVIETIELLAKSIKTGGLILIGEPYWRQIPTTQEIAQACGASSISDFLTLSELVVSFDNQGYDLVEMVLADQEGWDRYEAAKWMTMRRWLDKNSADNFAQEIRTELTIAPKRHVSFTREYLGWGVFALIAR

SEQ ID NO: 7888 - protein, 68 aa, Proteus mirabilis
DAWEIDVLEDLLSGAVVELAKREDAFCELQADNVATTINAGMSLSILINGLFLIVTDFPYILMCQMST

SEQ ID NO: 7889 - protein, 141 aa, Proteus mirabilis
VLALLSQKRAILLRKHLAKPKRLFAQTYSNPPAHGASVGTTILSNPELKEEWIEELTTMRERIQRMRQLLVTTLQEKGAKQDFSFIIDQNGMFSFSGLNKEQVERLRAEYGIYIVGSGRINVAGLTLENMVPLCEAIVAVL

SEQ ID NO: 7890 - protein, 97 aa, Proteus mirabilis
FNALKLTLTYKLCAIDRYLYIPIKRGSPYTQRYAPFISYSLDISRFSQYGLPYLLSQLSIVNNLIFVTLSSIKLCRYIHCLNPMQLNSARFNALKLI

SEQ ID NO: 7891 - protein, 138 aa, Proteus mirabilis
DMNWSFILILALFVVVGCVDKERNTSGSIEKVATEIATLTVQYHHDESRYPTFMLSKQSRFEMQAKEEKQKFNQLFKFGFEEPTTPTNSEYSYKKEQRIRKNDQSMIILPEAIPVWNKDKQEVEVKWSYRPKYVFDAY

SEQ ID NO: 7892 - protein, 72 aa, Proteus mirabilis
IRCWVFYCFIRAVGKNHTEFVLKAVRRSAEETLKDLRVINVNPEVYQEFINPLDATLVSNETLRKTVMSKSP

SEQ ID NO: 7893 - protein, 68 aa, Proteus mirabilis
TACCMWSLYASVSNSDVIIGVASKIIARQASSRSVFMSAKSLRLESIPEYDDNASLFVNISLRHKNKL

SEQ ID NO: 7894 - protein, 470 aa, Proteus mirabilis
KSRWRVKMNFPLIINVLVFVVLLLILAKLSQRQWSLSKKVLVGLVFGVVFGLALHAFYDAHDPIIKESILWFNIVGNGYVQLLQMIIMPLVFASILSAVSRLHQASSLGKISALTIGTLLFTTAIAALIGIVIANIFGLTAEGLVQGEQEAQRLAAIQHNYIGKVSDLTVPQLILSFIPKNPFADLTGASSTSIISVVIFAVFLGMAAIKLLKEDKPRGEKVLAAIDSLQAWIMKLVRIVMALTPYGVMALMTKVVASSNLHDIIQLGSFVVASYVALGLMFVVHGLLVGFTGLSPIKFFKKAGPLLAFAFTSRSSAASIPLNIETQTRRIGVPESIASFSSSFGATIGQNGCAGIYPAMLAVMVAPTVGINPFDPLWIATLVGIVTISSAGVAGVGGGATFAALIVLPAMGLPVTLVALLISVEPLIDMGRTALNVSGSMTAGTITSQMMRQTDKEIFNQEEEAELNVK

SEQ ID NO: 7895 - protein, 412 aa, Proteus mirabilis
LRSCQYITRYYSHCTKECLAGSCNSLYDIFRLPKFRKYTMDYKLNLDWQSFLESHWQKRPLLIKNGFSGFVDPLSPDELAGLAMEDEVDSRLVSCQDGQWGVKHGPFEHFEGLGDKDWSLLVQAVDHWHFPSAALMKPFRVLPDWRIDDLMISYSVPGGGVGPHLDQYDVFIIQGQGRRRWRVGEKIPMKQHCPHPDLLQVDPFDAIIDEELEPGDILYIPPGFPHEGYAIEESLNYSVGFRAPNARELFSGFADYVLANDLGSYRYSDPDLTPRDNPALVQHQELNKLHDMMEDLLAQPEVFRHWFGEFISQSRHELDLAIPEPLYENAEIHDLLQQGEQLHRLNGIRALRVGDSCFVNGELMDTHHIEAADALCQYDCIDKQHLGDALADPKFIRLLTHLVNQGYWYFED

SEQ ID NO: 7896 - protein, 224 aa, Proteus mirabilis
TFFCQKNIAKYLPSFSTTSNFVAIIVNAIYRRLPMAKANEIKRGMAISYNNKLLLVKDIDIQAPSARGASTLYKMRFTDIRTGQKVEERFKGDDILDTINLTRRAVSFSYIDGDEYVFMDNEDYTPYTFKKDQIEEELLFIPEEGLAGMQVLTMDGQVLALELPQTVDMEIIETVPGIKGASASARTKPATLPTGLVIQVPEYLSTGDKIRIHIAERRYMGRAD

SEQ ID NO: 7897 - protein, 249 aa, Proteus mirabilis
MVTCLTIRYFQLFVVCINHRIIILRLGFCMTLDTHNGVKVYTPTALKLYDWWVLNISNRYAWRCDTDKYLLPHFKNNLGENHMDIGVGTGFYLKRALANINKIALTDLNINSLDYAKKNIVDDKLTYCLQHDIYHKFPNEFNSSFDSISLFYLLHCLPGTMEGKKKVIENISKILTEKGVLYGATILGADVEHNFFGNKLMSVYNKKGIFSNYSDSADALEKVLSCFFYDVSIHIQGVVALFTARNKKL

SEQ ID NO: 7898 - protein, 464 aa, Proteus mirabilis
NSTWELPTMELSSLTAISPIDGRYGSKTSSLRTIFSEFGLLKFRVQVEVRWLQKLASCTDIKEVPAFEQNAIDYLDAIVANFNEDDAARIKTIERTTNHDVKAVEYFLKEKVAAIPALQQVSEFIHFACTSEDINNLSHAIMLETARQEVLLPAWRELIDTISKMAQAYRDLPLLSRTHGQPATPSTVGKEFANVAYRMERQYRQLTQVEILGKINGAVGNYNAHLAAYPEVDWHQFSEEFVTSLGITWNPYTTQIEPHDYIAELFDCISRFNTILIDFDRDIWGYIALNHFKQKTIAGEIGSSTMPHKVNPIDFENSEGNLGLANAVMGHLSSKLPVSRWQRDLTDSTVLRNLGVGIGYALIAYQSTMKGLNKLEVNESHLREELDSNWEVLAEPIQTVMRRYGIEKPYEKLKELTRGKRITAQDMVVFIDGLALPEQEKARLKAMTPESYIGFASQLVDKLD

SEQ ID NO: 7899 - protein, 229 aa, Proteus mirabilis
TLLWRVNMSFKLPIEAAIFDMDGLLIDSEPFWAQAEHEVFAQLGVDLSLADSMPDTVGLRIDQVIELWYQVSPWQGVTQQEAKERMIARVVQLIEDKKPLLPGVEHALSLCQSLGLKIALASASPHFMLERVLELFNIRHYFSAVVSAADLAHSKPHPEVYLNAAKALNVAPINCVSLEDSRNGMIACKAARMRSIVVPAAEQFNDKCWGLADVKIASLNELTKSQLLG

SEQ ID NO: 7900 - protein, 805 aa, Proteus mirabilis
HSLWDLQLFILVQLSFSLSLPLNGLIVVYYGILMQQEENNTQATQAEIRRKRKISTFWLLPVIAIFIASWLLFQHWQEKGVQITIDFQSASGIVSGRTPIRYQGVDVGIVQDVTLSNDLRRVIVTADIRKNLANALRKNTQFWLVTPKASLSGVSGLDALVGGNYISMLPGDGEKQFQFVAQEVRPKANIDKNQQIITLTADNLGSLNVDSQVYYRKVPVGKVYSYAIRPDNQGIFIELSIDKQYAHLIRQDSHFWNVSGFQGNFNLKSGASIKMESVSALINGAIAFDSPENSPPAQENQQFVLQSATSVDAGKALYGEDGLIISLTSEESWGVDAGQPILFRGITIGQIIQRNISDDGVIFDAIIAPEYKHYIYENSKFVANSRINVNMGLNGIEIQGATPQEWLEGGIHLIPGSQGAPKEQYRLYRNDFYAKASIEGNELPVTLTLKAASLPGIQKGSVVLYHQFQVGEIVDVRPLMDEFDIDVHISKQYRHLLTEKSVFWTEGAAKVSLNGAGLTVEATPLNRALKGAISFDNFENINNNVSRYKLYPSETSARAIGAQITLKTYDASKLSEGMPIRYLGIDIGQVETLTLSADKKAVSVSAVLYPEYVKTFARSGSRFAVVTPELTASGLDNLDSLIQPYIKAEPGNGGVYRIFELQTANITDSRYLDGLNLVLNATEAGSVQIGTPIYYRGLEVGAVTGLELGNMSDRVLIHIRISQKYQYLVRNNTEFWLSSGYNFSFGLTGGVFRSGTFKQFIRGGITFATPPSTPLQAKAKQEQNFILNAKEPKEWNEWGTAIPKP

SEQ ID NO: 7901 - protein, 432 aa, Proteus mirabilis
NERWSIRVSRSDFRSGIMAQLPLALVTALRFSKGRKRAGMVSLISIISTLGIMLGVAVLIIGLSAMNGFERELKNRILSVVPHGQIYSVEQPFISWQPALSRIENTEGVVAAAPYILLTGLLEKGTELKAVQVMGVEPNKQSDISLLPSYVQNNAWQHFQAGQQQIIIGQGVADALKIKQGDWLTILIPNNDDPKKLLQPKRIRLQVSGIFKLSGMLDHQLALIPLADAQQYLDYGKGITGIEVKTSDPFLANEIIHNAGLNSQAYVYAKSWISDYGYMYSDIQMIRSIMYLSMILVIGVACFNIVSTLIMAVRDKSGDIAILRTLGARDSHIRNIFLWYGLLSGMIGCVAGVIMGVVVSLNLTPIVSVIESMTGHSVLSGDVYFVDFLPSEIHAIDVFSVFLTTVILSLIASWYPARRATKLDPARILSGQ

SEQ ID NO: 7902 - protein, 433 aa, Proteus mirabilis
AVTRPPIFLILNFFPPWRISVSKRRVVVTGLGMLSPVGNNAEASWKAVCAGQSGIGLIEEFDTSHHATKFAGLVKDFNHEDYNLSRKDARKMDLFIQYGIAAGVQAIADSGLEVTEANASRIGAAIGSGIGGLGLIEENHSSLINGGPRKISPFFVPSTIINMVAGHLSIIYGLRGPTISIATACTSGVHNIGHAARIIAYGDADVMLAGGAEKATTPLGVGGFGAVRALSTRNDDPQAASRPWDKDRDGFVLGDGAGVLVLEEYEHAKARGAKIYAEVVGFGMSSDAYHMTSPAENGAGGALAMENALKDAGITAADVGYINAHGTSTNAGDIAEAQAVETVFGKGTDVLVSSTKSMTGHLLGAAGAIESIFTILSLRDQIVPPTINLDNQDEHCHLDFVPHKARKVENMDYALCNSFGFGGTNGSILFKRV

SEQ ID NO: 7903 - protein, 82 aa, Proteus mirabilis
ITYRKINSTEDYNHVIYKLIPCEVIVLLRMRELNKLPINNIDHQLINRFKMFLNKDIPLSNFNRSLRKSILHKASHKISQNH

SEQ ID NO: 7904 - protein, 307 aa, Proteus mirabilis
YYCRYHCERIWTMNDKKINPTLTVDNATVTYNNGHTAIYDASFSITGGTICALVGINGSGKSTLFKTIMGLVKPSKGTVTLNNQPIQQALKQNMIAYVPQTEEVDWNFPVLVSDVVMMGRYGKMGFFRIPSKQDHEVVEACLERVGLSGLGHRQIGELSGGQKKRVFLARAMAQEGTVLLLDEPFTGVDVKTENAIIELLRNLRKEGHLVLVSTHNLGSVPEFCDHVILINRTVLDSGPTETTFTQKNLEHAFGGVLRHISLSGPDLHDDDDPRSLTVITDDERAAVFYGHHEQHTPAHQSKRKQGD

SEQ ID NO: 7905 - protein, 86 aa, Proteus mirabilis
LIFRIDRSKIKINTPGTIYEIGTLQKNSVQPLVDIILSKKNNSSSQSSNNSGDDLLSKLEKLGKLKESGVLTEEEFQEQKSKLLNL

SEQ ID NO: 7906 - protein, 185 aa, Proteus mirabilis
IYLRLGTLNMMIYCYDDKISEIKIEQLTKLLYRCVLGGASVGYTDAETQVDDMRNYWLSVNHSLSTNTFKLITAVIDGQIVGVVGLELCTKPNGKHRGEICKLLVSPDHRHKGIAQQLMQKAEQIAWERGITLLTLDTITKGMTVSLYRFLGWQVSGEIPEFAQAVDGKFEATTIMFKLKPESNS

SEQ ID NO: 7907 - protein, 142 aa, Proteus mirabilis
FKERIGAFMTNDELIDKLNNFFPVFREIHGEHDGIYLIFGGFGTFFADLINLYGSGKVDEKSYFSQNIASIYKDKDILIKEIKNIFSFVDDLFLYQGDDVKDILNTCIFEAIMGSDYSYNLARKYLSKETYNHYLEITKRVI

SEQ ID NO: 7908 - protein, 318 aa, Proteus mirabilis
CRLRAEKYSGAGAIRLSKSYQQQLLSLLREWFPAIPLSQWQITALAGLGGGTFRLQSNGIDWVARYYGTEKTALFVRAKKESSILKQLLNTQLAPNIIKRHGAWFFFQWLEGEHLTHQQLFGSHLKSLAHQIAKLHQQKPFGFPLDLWHELSVYWYHIDRKRLSPKWLRLHHDFLCQPRRTLIKYAPAHMDLHPENILLSDSGIKFIDWEYAADIDTADSLMTFFAANQLNSAQQTAFLHEYCAYHHYTELNNDQQNRQHPQQQPFYSVNVLKQRILLREPFILYMMLMWYEVRWQQTKDNAFLAMSEPLRRYFSLMN

SEQ ID NO: 7909 - protein, 97 aa, Proteus mirabilis
IPKRLSPVTFQDLLRKLSSQNLMQEQQQRQAQFYFSLTLPFPILQEYIFFKFYIDGQIDSCSTMKVINLITLSYFDIIFISLLTKFLYFCCYCFMLL

SEQ ID NO: 7910 - protein, 284 aa, Proteus mirabilis
FIERSVSYGQTGEVFTAGHWYYHSYQYDPLGQLTAHLGSVQTEHFLYDAAANLLPRPHSEAPHNQVQGSDKYDYRYDGFGRMVSRYEKGSSSGQRYHYDSDHRIIAVDIDQGPLGYQRAEYCYDILGRRIEKRLWKASAIANTVTYHQHEPDEVYTFGWIGMRLVSEHSSAAPHTTVYHAYNDQSYTPLARIECTDNPLNPQRAIYYTHSSLSGLPEALTNSEGEIVWQGQYSAWGHLQRQTRPTSTFNREQNLRFQGQYFDKDKFVGNKFEQRLRWPVGRVSG

SEQ ID NO: 7911 - protein, 442 aa, Proteus mirabilis
SNIFRRYFVTKTKWTCIRNTQCLPRRILVSFFIHQSIIGNMKRLQAFKFQLRPNGQQEREMRRFAGACRFVFNRALARQNENYEAGNKYIPYTKMASWLIEWKSDTETQWLKEAPSQPLQQSLKDLERAYKNFFQKRTAFPRFKKRGKNEAFRYPQGVKLDQSNSRISLPKLGWMRYRNSREVVGEVRNVTVSQSCGKWYVSIQTEYEATEPQHESTSIVGLDAGVTKLATLSDGTVYPPVSSFKVNQRKLARLQRKLSRKIQFSANWQKQKRKIQRLHSHIANIRKDSLHKVTREISKNHAMIVIEDLKVSNMSKSAKGTTERHGRNVKAKSGLNRSILEQGWYEMRRQLEYKQLWRGGQVLAIPPAYTSQKCACCGHTAKENRQSQSQFECLECGYTANADINGARNILAAGHAVLACGGRVQSDRPSKQELAEVIQTSV

SEQ ID NO: 7912 - protein, 65 aa, Proteus mirabilis
IIVRNSMLSSNDDPQKRDLKHNLNDIKSTMNLKSYKYPFKIRLKILKRSAVIHNKNYSIFLLNFL

SEQ ID NO: 7913 - protein, 145 aa, Proteus mirabilis
CDNRSSWQQGSSMIKQAKRVYSLLIVLLMTTLLAGCFASHSDNKLYFNRQQSIVMEPSVLAVGIVAGKPLLTRYEQGSRATVTLSNTRSYPVSIRYRFYWYNEQGLEISPAGRVNDVMILGDGDTEISADIPNKTVSYVRVYLFT

SEQ ID NO: 7914 - protein, 298 aa, Proteus mirabilis
NRNSINMMRIALFLLTNLAVMFVFGIILSLTGIQGRSVQGLMIMAGLFGFGGAFVSLLMSKWMALRSVGGQVIENPTSEVERWLLDTVRRQSEQVGIKMPQVAIYDAPDINAFATGARRDASLVAVSTGLLASMSRDEAEAVIAHEISHVANGDMVTMTLLQGVVNTFVIFISRIIAQFVANFISSDEESENSNGNPWVYMGVSMVLEIVFGILASIITMWFSRYREFHADAGSAKLVGREKMIAALQRLKTSYEPQEESSMMAFCINGRNKSFSELFLSHPPLDKRIEALRSGEYLK

SEQ ID NO: 7915 - protein, 326 aa, Proteus mirabilis
KRERKIMEYITNKHWAKYIKGYIFTGCAIRDKNIVYFCLRKDIPYEKARNLWNSEIPSQLLCIYLDTPDDPIDYIRIEGFDNPKVGICLKPKEQGMLASRGDGGFVKCMGSGSKFPLEKVMDGDYANPKNIKCVGGYAYYVGTSREIYKRVDIGKWQRIQHGIPGGETNTDMGFTDLDGFSEQDMYAVGGAGDVWHYNGEIWIPCGFPSNEQLSAVLCAPDGYVYIGGEGGSLWRGREYQWEKLYHGSSAILLNQLRWFEDKVWACDDYRLQCWNGKEMVRPKDGDRNVIASGHMDVRDGILVVADDYNVDLYDGTAWHKIVRPYK

SEQ ID NO: 7916 - protein, 63 aa, Proteus mirabilis
IDKSLFSSMRLGFFFYGVSQIRVLGKFSPYRTLQHKKAYRGRPFYFQFTIVIYIQIVLCSSYS

SEQ ID NO: 7917 - protein, 110 aa, Proteus mirabilis
INERRFILKKIPIVLACLGLLLTAPSLARESKVLGSTTITFVGAIVEGGCYASSEENTVKTSCWNGKEMKDFQYKLDANQQFNSQLINNKGFMDIEWINDHLAVMNIVYN

SEQ ID NO: 7918 - protein, 292 aa, Proteus mirabilis
INFGYSLMKVTSAEKHALLLPDNRTLTWYESGPSDGQPVLFCTGAGMSGLLSMDADLLTKLNIRLITPTRPGLGESTFDPKKTLKSFSSDVLFLLAYLNIKNISVIGSSQGAVFAMAICYYGKVDKLAIVAGQDQLDYPEIKKLLSSDVVNMQQQALFDPDGLKTWIIENITADWLMDFILNYSADVDLALYQENKFFPVYQACMKEAFKYGNKGYAQDLLITMQPWGFTPEMISTPTTLWYGLKDTSTVHSPDFGKLLSQRFPHAQRYVYDNEGGSLLWTKTSQILTNLIS

SEQ ID NO: 7919 - protein, 94 aa, Proteus mirabilis
MKVGREYIIQGRVQGVGFRFHTYQWMKKQPITGYVWNRDDGSVGIRAFAEEQVLRKIEDWLAAGGPIGSKIVFWSATPCQYEEMADFSIRHYAS

SEQ ID NO: 7920 - protein, 231 aa, Proteus mirabilis
ASYGKFITIRYALFETGMAWFWSDNRLKNIYQVDGITNFTEANRKHTGILLIGIHSMSLELGGRIMGLCFPVNAMYRPHNNKAMEFIQTRARCRSNKGMIDRRNLKFMVTELKKGKAIWFAPDQDFGLKGTTFSPFFSVKETSTSKGAVILAKLSGAPSLTVTLVRNHGHDNKKYSLIIGKELHNYPTENIQNDTDRMNHLIEIEIMRAPEQYLWAHRRFKTRPKGEASFY

SEQ ID NO: 7921 - protein, 420 aa, Proteus mirabilis
RDLGGKMDKLLERFFEYISFDTQSKPSSKMSPSSDGQLKLAKALVQELKKLGFSDVTLSDKGCVMASLPSNVSWPVPVIGFISHLDTSPDFSGKHVKPQVLEDYRGGDIALGIGDEVLSPVMFPILHSMIGKTLITTDGKTLLGADDKAGIAEIVTAMVRLKAQNRPHGDIRIAFTPDEEIGRGAHYVDLKAFGANWAYTVDGGGVGELEYENFNAASVSIKIVGNNVHPGSAKGVMVNALGLASRIHQELPVEETPENTEGYEGFYHLQSIKGTVERAEMHYIIRDFDRNQFEKRKQNMITIAEKVGKGLHPDCYIELTIDDSYYNMHDKVVQYPHVIDIAKQAMIDCDIEPDIKPIRGGTDGAQLSYRGLPCPNIFTGGYNFHGKHEFISLEGMEAAVSVIMRIAEITAEREKAKVIC

SEQ ID NO: 7922 - protein, 384 aa, Proteus mirabilis
FNQGQIIRLKAKCLTWMITRRKMKKTAIALAVAVAAFATAAQAAPKDNTWYTGGKLGWSQYQSTGNNWDGVNIGNGSTHKDQIGAGAFAGYQYNQYLGFELGYDWLGRMAYKGSYNNGAFKAQGIQLTTKLSYPVMDDLDVYTRLGGMVWRADSTATINATSAGTQKRFSENDTGVSPVFALGTEYAITPNIATRLEYQWINNIGDKGTLNARPDNGMLSVGVAYRFNQETPAPVVEPAPVVAPAPVVENKTFTLRSDVLFNYNKSSLKAEGQEALNGLYNELANIDPTQGRVVVIGYTDRIGSQNYNLPLSEKRAQSVVDYLVSKGIPANSISAEGRGKENPVTGNTCDNIKARAALIDCLAPDRRVEIEIQGTTEVVVQPGQ

SEQ ID NO: 7923 - protein, 88 aa, Proteus mirabilis
GIKGGKRIQSTRQNRINGEIRAHEVRLTGLDGEQIGVVSLKEALEKAEEAGADLVEISPNAEPPVCRIMDYGKFLYEKSKTLKEQKVF

SEQ ID NO: 7924 - protein, 303 aa, Proteus mirabilis
QLKGGMDMRITLRQLEVFTEVLKSGSTTQASQQLALSQSAVSASLTDLENQLGVQLFDRVGKRLVTNEHGRLLYPRALSLLERATEVEQLFQAGNGALRIAASTTIGNYILPQMLGNFHRNYPDIPLEMSIGNTEEVVKSVSEFRVDLGLIEGACQSSELISQKWLLDEMVIFCSPEHPLAKAKTVTLADLQSAPWILRENGSGTRDVLNHLLFASLPGYRIEMELGNSEAIKHAVMYEMGISCLSRRVIQDQIESGSLKEIKVEGLKLQRTLYLVYHRQKHVSDALKKLLSYCNAEHLIDNA

SEQ ID NO: 7925 - protein, 66 aa, Proteus mirabilis
RNGGSLKSSELIKLLEKNGWILDRIKGSHHQFTHPDFSFVVTVPHPRKDLKKGTLNQIIKSAKLKN

SEQ ID NO: 7926 - protein, 300 aa, Proteus mirabilis
KLFMDIRVLRYFIEVVQLNGFSRAADALFITQPAISRSIKKLEDELGTVLLIREVDGVKLTDDGAILYEHAKQILAQFNSMNKALNDKDEPLTGALNVGLPPVIASTYFADIIMAFSSRHPNVELKIFELGTKQMEDAMLEGTVETAAVMLPFNDKDFELTIFSEDHLMLLVAQSHPLAKDKKVNFKQLITERFIFFSEDFRINDLVRSACGIYNTEPQIVGRSNHLDLIIAMVKAGVGITLLPNSMCNKYPIDDLVVIPITSPRLSYQLALATNQNSYQSRSCQAWNKLAIEKLMKENI

SEQ ID NO: 7927 - protein, 133 aa, Proteus mirabilis
EVIMSLNTLKTSWGKLSAIAVLFLGMSCQQALAHAHLKSQLPAEGAAIEQAQAPKVITLDFSEGIELAFSKVKVTDKEGKEITVGKLSLDPVNNTKLLLPLEGELAEGNYSVDWSVVSVDGHKTKGSYQFSVK

SEQ ID NO: 7928 - protein, 264 aa, Proteus mirabilis
EYIMFLVDSHCHLDSLDYEKLHKNIDDVVEKAQQRDVKYMLAVATTLPGFKNMRELIGKRDNVAFSCGIHPLNLDEGHDVAELARLAAEADVVALGETGLDYYYQQENASLQREIFREHIRIGRQVNKPVIVHTRSAREDTLTILKEEKVQDCGGVLHCFTEDKETAMALLDLGMYISFSGIVTFRNAEQIREAARIVPLDRILVETDSPYLAPVPHRGKENQPAYVRDVAEYMAVLKGVSIEELAQQTTRNFATLFQIPNLAD

SEQ ID NO: 7929 - protein, 407 aa, Proteus mirabilis
IIIIFCRFLEFNCVQEQRPSYFSLILILGLISMLMPLAIDMYLPSLPTIARDFGVPGGQVQMTLSSYIFGFAIGQMVYGPMADSLGRKPVILGGVIVFALASSACALSDSIDMLIGMRFLHGFAAAAASVVINALMRDMFSRDEFSRSMSFVALVMTIAPLLAPLLGAWVMNWFSWHAIFWSIAIAAIIAAALIALYIPETLPKQHRQRFSLRVTFSQFISLFRARRVLCYILASGFSFAGMFSFLSAGPFVYIELHGIPFDQFGLYFGFNIIFLIVMTSINGRYVRRFGALNMLRFGLTVQFLMGIFLILVVALNLHFYFLVVGVAMYVGGIAMITSNAMAVILEDYPHMAGTVSSLAGTIRFGVRALVGTAIAMLPAKTEWPMVSSMAFCVICAMSFLLLARRYK

SEQ ID NO: 7930 - protein, 642 aa, Proteus mirabilis
MPIITLPDGSQRQFENAVSVMDVAADIGPGLAKACIAGRVNGELVDACELIEQDSQLAIITAKDDEGLEIIRHSCAHLLGHAIKQLWPQTKMAIGPVIENGFYYDVDLDHSLTQEDLETLEKRMLELAKTDYDVIKKRVTWAQARETFVARGEDYKVAILDENISQDAHPALYHHQEYIDMCRGPHVPNMRFCHHFKLQKIAGAYWRGNSDNKMLQRIYGTAWADKKQLKAYLERLEEAAKRDHRKIGKQLDLYHMQEEAPGMAFWHNDGWTIFRELETFVRCKLKEYDYQEVKGPFMMDRVLWEKTGHWENYKENMFTTSSENREYCIKPMNCPGHVQIFKQGLRSYRDLPLRMAEFGSCHRNEPSGALHGLMRVRGFTQDDAHIFCTEEQILSEVNNCIKLIYDVYSTFGFEKIVVKLSTRPEKRIGEDALWDIAETDLAKALTDNNIEFEYQPGEGAFYGPKIEFTLYDCLDRAWQCGTVQLDFSLPGRLGASYVAENNERKVPVMLHRAVLGSLERFIGILTEEYAGFFPTWLAPQQVVVMNITDGQADYVQKLVKELQDAGIRAKADLRNEKIGFKIREHTLRRVPYMLVCGDKEVESGKVAVRTRRGKDLGSIDVNDFKEKLLQEIRSRSLHQLEE

SEQ ID NO: 7931 - protein, 590 aa, Proteus mirabilis
CMVMAFTLRPYQLDAVNATITYFRQHKTPALIVLPTGAGKSLVIAELAKRARGRVLVLAHVKELVEQNHSKYEAYGLSADIYAAGLQQKESRGKVVFGSVQSVARNLSQFEHAFSLLIIDECHRISLSEDSQYQQVIKQLQTINPQLRILGLTATPYRLPTGWIYQYHYHGMVKGDDNCFFRDCIYELPLRYMISHHFLVPPTRLDMPILQYDFSQVRTSQNGIFNQEDLNREIKKQQRITPHIVSQIIEYGEQRRGVMIFAATVEHATEIFTLLPQGQAALVSAETPSSERDALISQFKQQQLRYMVNVAVLTTGFDAPHVDLIAILRPTESVSLYQQIVGRGLRLFAGKTECLILDYAGNPHDLYLPEVGSKKPNPNSKPVQVFCPLCQFANTFWGIVDADGDIIEHYGRRCQGWELDEQGQKKQCDYRFRFKLCPHCNEENDIAARRCVHCNEILVDPDDMLKAALKLKGALILRCGGMQLLSGQDEKGEWLKINYYDEEGTSVSERFRLKTPAQRKVFELKFLREHQRAPGVPLVWHNAQDIINQFDLLRYPDFIVAQKNKKDGFWQIRNKLFDYHGRFRKADTLY

SEQ ID NO: 7932 - protein, 189 aa, Proteus mirabilis
GITMSQKPCRIILTGGPGSGKSTIINKLRRNGYSCSIEAGRAIIQDQSHIGGSALPWIDPLAFAELMLSWELRSWHNASNIDDNSKPYFYDRGIPDIAGYLHFCERPIPQHLENAIRLYRYSTTVFIAPPWKEIYLQDKERQQTFDEAVATYQAMLAIYRQYNYTLIELPKADVNQRVKFIINNITSLS

SEQ ID NO: 7933 - protein, 89 aa, Proteus mirabilis
SVTITLVCQNDTKFYDLYAIVILCQLERSLSQHVTFIAISKPLNVNLITFNKAFIFLSYLIDENLVFIYLIKDFLSKPPCIPFIYIFQS

SEQ ID NO: 7934 - protein, 147 aa, Proteus mirabilis
GATMTKTVLVPIDFTELGLLDKVVTHLKALAMADKLNIHFLSVIPSYESFVGFAFGSQDRLANDKQRIEIALSTLNDSLSHIEIPNSTSQSYISVGNPRDRILETAKKIQADLIVIGSRNPGMKTYLLGSTASSVVSYAESSVLVVR

SEQ ID NO: 7935 - protein, 285 aa, Proteus mirabilis
RRTMMKFVGAHVSAAGGVDQAVLRAHEIKATAFALFTKNQRQWKAAPLSTESIDKFKKNCEIYGYGPAQILPHDSYLINLGHPEEEALEKSRAAFLDEMQRCEQLGIELLNFHPGSHLKKIDVDKCLQRIAESINITLDKTQNVTAVIENTAGQGTNLGYRFEHLAAIIDGVEDKSRVGVCIDTCHTFAAGYDLRTVEDCEKTFAEFDNIVGFQYLKAMHLNDAKSELASRVDRHHSLGQGNIGKVPFTYIMQDTRFDGIPLILETINPDIWPEEIAWLKSQQTQ

SEQ ID NO: 7936 - protein, 677 aa, Proteus mirabilis
RIYILGESGMVVLKKNKIALGVVAALASSFVMTASAEDPERLLVTTASGFKQTVEDAPASVSVVTREQLETKSYRDVTDALKDVPGVLVTGGGSSSDISIRGMDPKYTMILVDGKRVASRETRPNSDNSGIEQGWLPPLPAIERIEVVRGPMSSLYGSDAMGGVINIITRKAQKEWNFSLRGDTTLTERKNEGNTGQGSFYAAGPLIDNVLGLKLQGQYSHRGEDRRVDGYNRQITASGGGTLSWTPDEKNTVEFEFKKDNQHRDSRVGYSKSAELVKGKAPQSSFTDYELTHYALTHDGIYDFGTMNTYVQRDESRNPSRKMDYDDTTVRNQTVFMFGDHMLSVGGQYRYEELKDEGNKLKGNNKLDRYSWALFAEDEWTLTNDFALTAGLRMDKDENFGTHWTPRVYGVWHLADEWTLKGGVSTGYRSPDLRQATATWGQGTGGGRYDAVIYGNPDLKPEKSVTEEIGIIWDNRDNLTASLTIYNTDFKDKITEVRRCDSRSDKAPSMLDCTLADGVGNSGDPYDFVSDRTNVDKANMRGVEVTANWIISPEWNLAANYTFTDTEQKSGDFKGKPLNKQPRHMANATLNWETTPEMETWARINFRGKTSDYLSRTSMSKSTPSYAFVDVGTSYSLTKQLNLIGGVYNVFDRRIERDNYGSTLEGRRYNIGLNYNF

SEQ ID NO: 7937 - protein, 196 aa, Proteus mirabilis
GSHMKKMLFVVAAVFLLAGCPSMLPQQPPAPVEPVTPTEPTEPPKPIEPPIEVVPTPPKITSINWNAAIQPLIREMSVTDDLATGKLLVVDNVKNNSGGNIQAVNATNTIIDSVNSISALQTVPYAQMMSARKALGLSGEDSLGLRSAAIGLARYLQADYILFSTVDGKKDNRVISMQLMSVASGEILWSGRHKVE

SEQ ID NO: 7938 - protein, 490 aa, Proteus mirabilis
KLNMHKKQRSPFSLRTRFLLATSAIILALTLSYGLVAIVGSIVSFDKTTFMLMRSQSNLYYSLAQWKDGQLQIEFPTNLNNNNTSLVVIFDEKGNVLWTPTDLPQVIPNSIAPKWRNKEGLFEISVNVKTTRFMLQQLPQYRAYLKKLNEYSSNDTLTHSVVINHYPAADNMPYLSIAVIDPIPQSLQNVSRVWDWFLYILLANFLLVIPLIWLAAHWSLRPIKSIIEQISALEKGTRDNLDENPPKELKGLVYNLNILLRNERNRYSKYRTSLSDLTHSLKTPLAVLQSTLRALRAGKQMSIEQAEPIMQSQIERISQQVGYYLHRASLHGDHDITTRKLHSLSGLLDNLCSALNKVYQSKGVDITLNVSPEMMWLGEKNDFMEVMGNVLDNACKYCLEFVEINVSHDDNCVIITVDDDGPGVSPEKRELIFQRGTRADTLRPGQGLGLSIAVDIIEQYNGDITITDSPLGGARLIVTFAEQQLTTEIE

SEQ ID NO: 7939 - protein, 103 aa, Proteus mirabilis
YKDICVMAVLSKIIIKQTRSECLCKKIPITSDNTFSKQEYKASFIIVFSYFLITHLIIFSLYLSNDKHTWLLLGLQSAFFIILPWLFYGTRTLLKEAIYYLIR

SEQ ID NO: 7940 - protein, 370 aa, Proteus mirabilis
DPFMSDNSQKKVIVGMSGGVDSSVSAYLLKEQGYQVVGLFMKNWEEDDDTEYCSASADLADAQAVCDKLGIELHTINFAAEYWDNVFEHFLSEYKAGRTPNPDILCNKEIKFKAFLEYAAEDLGADYIATGHYVRRRDIDGKSQLLRGVDNNKDQSYFLYTLSHQQIAQSLFPVGEMEKPEVRKIAEKLDLATAKKKDSTGICFIGERKFTDFLSRYLPAKPGPIVTVDGETIGEHQGLMYHTLGQRKGLGIGGTKEGSEDPWYVVDKDVANNILIVAQGHEHPRLMSVGLIAQQLHWVAREPITEAFRCTVKTRYRQADIPCTVTPLDEDKIEVRFDYPVAAVTPGQSAVFYQDEVCLGGGIIETRIQE

SEQ ID NO: 7941 - protein, 125 aa, Proteus mirabilis
KYRITHQLKEQVHFGHVYGDRLALFVVETSNPKEWYENPFNIDGVTKGMYKGIKQIDPQWVTPDLTDANVQDPASMDFYEPTYYVIGGRKYHKSHFIKFVPFPVPNVLKPMYNYFGVSVPERIYE

SEQ ID NO: 7942 - protein, 412 aa, Proteus mirabilis
TLSISNRNSTVFMYNSVSFFIGLRYMRGRAVDKFGRFVSWLSALGIMLGVAALITVTSVMNGFERSLQNSILAYIPQAVITTPNGQLPKQDSTAQMLLKREDVINVVPLVEGDVVLQSKDNIGVGVMLGIDKAHDEPLTQFIRYGDFSLLKPGEYGVILGSGLAKQLKTKEGDSIRLIVPGVSQLTPMGRVPSQRLFTVKGIFQSGGDADASQLLVNQQDAARLMRYQPGNITGWRLFFSTPLNIEKYSAEPLPAGLSWKDWRERKGEFFQAVKMEKNMMGLLLSLIIAVAAFNIITSLSLLVMEKQGEVAILQTMGLKRSQIMSIFMLQGAGAGILGAIAGGLLGALLSSQLNVIMPAVGLIPHGVELPATLEWSRVFMIGFAAIVISLLSTLYPSWRAATIQPAEALRYE

SEQ ID NO: 7943 - protein, 82 aa, Proteus mirabilis
PYGITKFIKGNSMSNTMTGTVKWFNDDKGFGFITPKDGSKDVFVHFSAIQSDSFKSLKEGQEVSFSIENGAKGPAAANVIGL

SEQ ID NO: 7944 - protein, 268 aa, Proteus mirabilis
FFVFNKIHKNWYRLRDIMQSYHSLSAQVYQLDKPIGCSFGDVEYYQQRLKDVKGKILEPAVGTGRILIPLLQSGFNIEGFDLSEEMLEFCKKNLIEHGFTTNYVTQNNLVTFEVNTPVEAIIIPTGTFLLLNTQQQAIQALKQCYQALEFGGRLLVDISLAHHFVKGECTSRQFNTPEGDLITLQIINAEIDYINQLTTSHHRYDKWRDGKIIESEWEVFSLKWFGVSEFEQILRLIGFKQITISADYQYLQTPSNMTEIMTFEAYKK

SEQ ID NO: 7945 - protein, 209 aa, Proteus mirabilis
NYLIHRLRESPMRKITDWTTLEGNLVRLVPLSMEHASPLRELIVKDRPDELWFTTVPSVTTLKQDIEHKRQLQKQGVMLPFAVIDKRRERVVGVTTYMNVDNHTPRVEIGSTWYAKEVQRTGINTEAKYLLLKYALEDLQCIAVEFRTHILNQTSRRAIERLGAKLDGILRNHRLTTNGQRRDTCIYSITDYDWQAVKTHLEWLMKKYP

SEQ ID NO: 7946 - protein, 303 aa, Proteus mirabilis
MNLIIKGLLYPFFVFFSAYALSFGCSVDNGYDIESGNYNIYVQLEAEVQPYQNLIVDLSRHLKCWNSYGGWQDVDHINLEPGTGLSGPLFNFSGSVYWYGNTYSLPLNSATKVLHIGDLTPMPMPMMLYLTPINNSPAGGVLIRSGETIATINMYKIADWDGGNPKYFTWEIVSKYDVTMPISGCDVSSRNVNVNLPPYPGEAPVNLNIHCAQPQNISFYLSGQTTNDDTTFINLAGSAGEVSKGMGVQLMRNGYVIPANKAISLGRVNSSTSLGLKARYGMTGERVTAGKVKSIIDVNFIYE

SEQ ID NO: 7947 - protein, 302 aa, Proteus mirabilis
CKIMTPEDVYILCRIFHFVAVMFMFGLSCSAAILAKEKFVPLIQVRLRPALAISTITVFVSTYLWMIVQSGIMGDGWQDAWSLTIWQAVLGTSFGQIWQWQLVLSSLALIALFIHQRSIRNISLLLISTLMLVLHAFIGHSAMFTGSEAVIYKLNQSIHLISGAYWFGGLWPFVVCLQFLRNKDELADGMIKPIIATMKRFSLFGHFAVLLVIASGIVSAIMLLPGWPATTQLSSEYQSMLWLKIAFVALMLGLALVNRYVLVPHIRKKNNFQWLLINSWFELLLGTMVILTVAIFAINSPV

SEQ ID NO: 7948 - protein, 184 aa, Proteus mirabilis
LVIIKPDDRWRWYFDDEQQKLMLDLANGMIFRSRFPSKMLSATAHQSSPFTVDDAALYYGYDEQIRQIDMPSESRAELALNALIAHRFLKPLMPKSWYFEVSHSSTRPYLAQVVETALKDSNEKVLFLVAEVGEQACLCLLAQPQLALFDRTLTFCDPLKIMNDRLSEYHKQSEPRSFLYEKVI

SEQ ID NO: 7949 - protein, 94 aa, Proteus mirabilis
PYSLVLFFKLANTANGFGFSDNSSGSSPNTCSASDTSQCSKSCTGTTGKLRIISSSIIASKSISPKSSTSIGSYSSGNASARSSLTTGLKQYVV

SEQ ID NO: 7950 - protein, 153 aa, Proteus mirabilis
DNSLMYHLCFDNIAPKLTKSKYIQKGKYTMTISTLSQQLREGNLFSKQCPSREILKHVTSRWGILILIALRDGTHRFSDLRRKIGGVSEKMLSQSLQVLEQDGFINRVSYPVVPPHVEYSLTDLGEQISEKLTLLADWIEINLPNILSRQEVE

SEQ ID NO: 7951 - protein, 103 aa, Proteus mirabilis
LRVITLLARQEFFIAAGNPKAILIFTAFLPQFVSPQLPASSQFLILGSLFLLLEFIAIMLYAWLGLHMKKLQKKPHAKKVFNRMCSSLLASAGIGLLVSQKSH

SEQ ID NO: 7952 - protein, 385 aa, Proteus mirabilis
ITPMRVIIMMKRNILAVVIPALMFAGAANAAEMYNKDGNKVDIYGKVDVRHYFADKDSGEDGDASRARIGFKGETQINKDLVGFGRFEYEVKTNNTEGSEGNNKTRLAFAGLKFADFGSLDYGRNYGVIYDTNAWTDVLPLWGGDSMAQTDVYMTGRTTGVLTYRNTDMFGYVDGLSFALQYQGKNNENTNNTRGTYDPKDPASNKADAKSNGDGFGFSTAYNLGWGVTLGGGYSSSARTAPQQHASLAGGERAEAWNVGGKFEANNVYLAAMYGETRNMTYFGKYKDIANKTQNIELTAQYDFADLGIKPSLAYVQSKGKDLGVAQGNDQDLVKYISVGSFYKFNKNMTAVVDYKINLLDDNDFTKTYGVATDNVVGLGLTYQF

SEQ ID NO: 7953 - protein, 70 aa, Proteus mirabilis
IAAIPIDSTTIIPPIVCIVATLLEVAIKFNVIKIINLRIKKAERPTIKEITKFQALTIKLSLVLPNSSVI

SEQ ID NO: 7954 - protein, 231 aa, Proteus mirabilis
GDVLLLPELHLRCYTQDTVSHQHENIWQIIFGLTGTMEVNFNRQDFLISQQNYLIIPPTIDHAFAGHLNNKNLILELPVTSQWRLNERGGIFALSPAAIGLLAWVHQYPQAPEHHSTLARLLLAQMKVQPSWGDKLDLWLEDKLHMPLTASDIAGALNISISTLQRKVKAELGISIMQYVMQKRLAKSAELLKYTSLTIENIALAVGYDSHSAFSQAFRQYFHKTPSEYRQ

SEQ ID NO: 7955 - protein, 117 aa, Proteus mirabilis
RLKMTMKNDNKGYLLTLICDNSNDKVEKIFLNPKILYIPDVAAKEILLLTNELKGKIDLSAQALTLTLTNKNNGVSVDKECEIKDLLDPDMASLMVKDLINIVRGYDMDEEANVCGW

SEQ ID NO: 7956 - protein, 94 aa, Proteus mirabilis
TKKIIAQASFDRKFNSMSTIDERVKKIIVEQLGVKEEEVVNSASFVDDLGADSLDTVELVMALEEEFDIEIPDEEAEKITTVQAAIDYVENAGK

SEQ ID NO: 7957 - protein, 379 aa, Proteus mirabilis
YKEIFMEHFTKKSLFTCDKTNENLPNKPGVITHCQELASDLGLSEAFAQYTISYTSCDSVHGEIIREDTGAVFIPKSQAPKDGWPVIVWNHGTVGIAPTCAPSLTPKNSRVSQYLNTWLSLGFAIVAPDYPGLGSSGLHHYMDERATAWSALDSAKAVLKGGFSLSNRFIFMGQSQGAHAAFASVGYQPEYAPELNILGAIVTGTPYFSDNLLENFISDGVQDEGDRKLPYAMYLYLSAADKNPNLKVEDYFQELAIPYVEKAKTLCISPLSQLVMDNKLNASNSLKPKFYELLEQEASSLNYRKLLVDKPVFIGIGLEDIHVLTRWQQEFARDVLEAGTNAYVYEYPNIGHLDVYNVSLRNSVPFVFELMKNEHSKID

SEQ ID NO: 7958 - protein, 77 aa, Proteus mirabilis
PLRINQLKFTINCKLDINTKLFYLLGALKICTILKIIYKIIYVLIIKISGNNNNNIVGFSLHLALLNNKCIINYLTG

SEQ ID NO: 7959 - protein, 128 aa, Proteus mirabilis
WLGIKINNKVIKMAEETIFSKIIRGEIPADIVFQDDTVTAFRDISPQAPTHILIIPNKLIPTVNDVTAQDEQVLGHLFVVAAKIAQQEGIAEEGYRLVMNCNKHGGQEVFHIHMHLLGGKPLGPLLSK

SEQ ID NO: 7960 - protein, 168 aa, Proteus mirabilis
DLLMPQLNFYQELTDNLSALLSGENDFIASLANTSALIYEKLDKINWVGFYLNDGNSLVLGPFQGKVACVRIGFGKGVCGTAFSENKILRVNDVHQFSGHIACDSASQSEIVLPLEVNGQIIGVLDIDSPIFGRFDKKDENGLKALCDVLCEHLKTCHTAKYCEFCVR

SEQ ID NO: 7961 - protein, 233 aa, Proteus mirabilis
FLLMYTRWNMRILIIEDNILLRHHLSVQFRDAGHQVDAAQDAKEADHFIAESTPDVAIVDLGLPDEDGISLIRRWRENNITIPIMVLTARESWQEKVTALNAGADDYVTKPFHFEEIVARVQALMRRNMGIASQILTIAPFELDLSRKEFMILGEQIKLTAFEYTILETLMRNQNKVVSKDVLMRQLYPDAEQRESHTIDVLMGRLRKKILQKYDNDVIVTVRGQGYRFDMKA

SEQ ID NO: 7962 - protein, 406 aa, Proteus mirabilis
RAMILDATPIITSLLDTDAYKLHMQQAVYHHYSDIPVVAEFRCRSDERLGEYATTLRHQVDMMADLSLTNEEFGYLQSLPFFKNDYLQWFKHFRFKPEQVHIATTADNQLTIKITGPWREVILWEVPLLALVSEIVHRARSPQITADDAVIQLRKLIDIFYRDAAEQQIDLADFKLMDFGTRRRFSYDVQRAIVDELKNHFPYLIGTSNYHFAERMQLAPVGTQAHEWFQAHQQISPELANSQRAALQSWLDEYPDQLGIALTDCITMDAFLRDFDMPFASRYQGLRHDSGDPIEWGEKAIAHYEKLGIDPMSKVLVFSDSLDFQKALALYKHFHKRIRLIFGIGTRLTCNIPNITPLNIVIKLVECNGKPVAKLSDSPGKTICEDDEFVDKLRKAFDVPLVRQAC

SEQ ID NO: 7963 - protein, 104 aa, Proteus mirabilis
MTMINSTIAHKIKQRRKELRLTGIEMGNRLGISQQHYSRIENGNIKITVELLFSIAFILNMTPQSLLPNYNLLDKKIINLSDEKNIIKAKQALSAEFIIPIKEK

SEQ ID NO: 7964 - protein, 147 aa, Proteus mirabilis
KCVFLLLQLNDPLTGIMMNKEYSAKWEERFDFFEKYGSPKSPEYKAAYKALTFGKRILIGMNIWAFFFGFIYFLILGLWRKALTLFGINVAIIIVVSFIVEGLSLSPSILNVVSIVLNFLWAATANYAYYLKEKKNDQGWNPFTGVF

SEQ ID NO: 7965 - protein, 1173 aa, Proteus mirabilis
ALAMSLKMCWELTTTKSSHYTLMSSEYRYQLPVKQGDTRQLGQLTGAACALECAEIIKRHAGLVVLVTRDMQNALRLQDEIRQFCDYPVETLSDWETLPYDSFSPHQEIISNRLSTLYRIPSLLKGILILPVNTLMQKVCPTDYLASHALIMSKGEQLSRDNLRKTFDEAGYRHVEQVLEHGEYATRGALLDLFPMGSEFPYRIDFFDDEIDSLRTFDVDTQRTLTEVEQIKLLPAHEFPTDPNAIELFRSQWRERFEVRRDPEHIYQQVSKQVLPAGIEYWQPLFFSQPLSNLFAYFPQNTLIVTQDLQDCADKFWQDINQRYESRRVDPMRPLLPPDDIWLNVETLNQQLKQWPRIQLKTQALPEKAGYTNLGYQPLPDLSVNAQSKSPLDNLRRFQEQFSGSIVFSVESEGRRETVQELLSRIKIAPKQIIELADAKEKGCYFIIGSAEHGFIDNYRQLALICESDMLGERVHRRRQDNRRTINTDTLIRNLAELSPGQPVVHLQHGVGRYQGMTTLEAGGVKAEYLILSYAGDDKLYVPVSSLHLISRYSGGADENAPLHKLGGDAWTRARQKAAEKVRDVAAELLDVYAQRAVKSGFAFKLDKEQYHTFRQSFPFETTPDQEMAINAVLSDMCQAIAMDRLVCGDVGFGKTEVAMRAAFLAISNNKQVAILVPTTLLAQQHFENFRDRFANWPVNIEMISRFRSAKEQQQITEKLAEGTIDIVIGTHKLLQPGIQWKDLGLLIVDEEHRFGVRHKERIKAMRANVDILTLTATPIPRTLNMAMSGMRDLSIIATPPARRLSVKTFVREYDDLVVREAILRETLRGGQVYYLYNDVENIEKARDRLAQLVPEARIGIGHGQMRERELERVMNDFHHQRFNVLLCTTIIETGIDIPSANTIIIERADHFGLAQLHQLRGRVGRSHHQAYAYLLTPHPKAMTKDAHKRLEAIASLEDLGAGFALATHDLEIRGAGELLGEEQSGQMNTVGFSLYMELLESAVEALKEGREPSLEDLTNQQTEIELRMPVLLPDDYIPDVNVRLSFYKRIASAKDLNELNDLRAELIDRFGTLPDAGRNLLRNAAIRLSAMSLGISRIEAHDKGGFIEFGEKNNVDPTYLIGLLQEQPSVFRLDGPTKLKFMISLTDREKRLTFIDDMLTAFSEHKINALSV

SEQ ID NO: 7966 - protein, 185 aa, Proteus mirabilis
GKEMSEHFQGKFEAELKYHLKRPQDFIDALQLAGATLFISKNDETDWYLEHPNTPFPAPSISLCVRKMVPSGINLLIVKGPEQAQCEAVKIEDAEKTVSMFKTLGYHCILNYTKSRQIYFLDQFHITIDKLDNLGYFAEFAIMTDDESKLADYKLQLHNLAYQFGFNDSEQEHHNYKTILLSKLA

SEQ ID NO: 7967 - protein, 290 aa, Proteus mirabilis
KPRIAMMKLKLRHRRLRKFRKIKSLRRQHSRCRYFHLTHKTEHEMNLPKVVVLTGAGISAESGIKTFRSEDGLWEEHRVEDVATPEGYHRNPKLVQQFYNERRRQLQQPSIQPNEAHYALAKLEQYLGKDNFLLVTQNIDNLHEKAGSKHILHMHGELLKVRCPQSGQVFEWKGDLSTTDYCHCCQFPSPLRPHIVWFGEMPIGMDEIYHALAQADLFIAIGTSGNVYPAAGFVHEARLTGAHTVELNLEPSLVESEFEEKHYGPASQVVDAYVHKLFDLINDPKADLTQ

SEQ ID NO: 7968 - protein, 727 aa, Proteus mirabilis
GLFVFNLFNGARRFIYNSHFLYYIRIIIALTGTTLFPWALGQEPKYTIPLTLGVVAAALTDLDDRLVGRLRNLVITLCCFLLASTSIGLLYPYPILFFCGLAISTWGFILLGALGQRYATIAFGALLIAIYTMLGMPIFPEWHEQPIWLLLGAIWYNLLTLIGHLLFPIRPVQDSLTRYYQQLSAYLEAKAALFDPDIEGDQQQLLYNLALANNQLIEAMSQTKLTLLSRLKGDRGQRSSRFTLHYYFVAQDIHERASSSHIQYRLLSDRLRHSDVLFRFQRLLSMQARACEQVAQSILWHKKYQHNPHFERAITHLENALNNVKNSTSDPQIIAPLYNLLQNLQGIDALLKSISTEQYQISHDQKEETQLSDEGLTGWRDIVLRIKGHLTPKSALFRHAVRMSLVLCIGYVIIQFFDLHRGYWILLTSLFVCQPNYNATRRRLTLRVSGTIIGILIGFPILYFVPSIEGQLVLIVVTGTLFFAFRTVQYAHATLFITLLVLLSFNLLGEGYDVALPRIIDTLIGCAIAWFAVSFIWPDWKFRQLPLLIQKTMTNNCYYLDAILIQYYQGRDNSVNYRIARRNAHSSDGELASLISNMSSEPKSFQTSQEEAFKLLCLNHTLLSYISALGVHRCKIEDEAVLTLLNDTVCYIDSALRRKKPQDNDFIQSHDQLIARVNAQPSSDNARIQLVLTQIRLLLDLLPQIVNCIELIEQTEWQNDKDKLATA

SEQ ID NO: 7969 - protein, 127 aa, Proteus mirabilis
YILVLIYFFKWKITMKRFLFAGILMLFSFQTFSAPISTVSKLQFGDAWPFTREEVMLNCRADGAWFVINPATLAQYPLNNIAMEQMKSGKVNAQLIDSILLPDPNTPDKKKSLEAIESAFLSLCEKN

SEQ ID NO: 7970 - protein, 209 aa, Proteus mirabilis
GKSVTMRNKPFMRMLKLIPAFIVVATLSACSSQNASSRLANSTTAPLNKSSSTSISQASQDEFESLVKNLDIKSKILDQYADWKGVAYRLGGNTKSGIDCSAFVQRTFRDQFGVELPRSTSDQQFAGTKVNRSTLKAGDLVLFKTGRTMRHIGIYIGNDKFVHASTSSGVIVSEMSNVYWKNRFYTARRIIDNNTTTSLADNYSQASLR

SEQ ID NO: 7971 - protein, 157 aa, Proteus mirabilis
IGTVMKKPLSLWITQFLIVCCIILILYFFITNASLLLNLYSFDMPAEIKIEIYLWSFIRLLVLIIQISALYFSFRCDKRARVLTILAWLPIIIVMLWSNFHEGLTSLNESGISYDNDAQRSGGIIGKLILAGLSLWLTSIILFSKKLKRYFLFEKSE

SEQ ID NO: 7972 - protein, 320 aa, Proteus mirabilis
TWHVGSPSPRTSKFTSTYFTIPASKRRYSTRRGATMNELMEFFIEPFQYPFMQRAIIAAVIIGIACAILSCYMVLKGWSLMGDAISHAVLPGVVLAYVTAIPLTIGAFLSGLFCSFATGYLKEHSRIKEDTVMGIVFSGMFAVGLVIFASVDTDQHLMHILFGNILGITPDVLIQISAICLITITIMLVKQKDFMLYCFDPNQARIVGLPVALLHYGLLSILALTIVASMQAVGIILVVAMLISPGITAYLLTRSFSRMITLAILFSVISSVIGTFISFHIDGATGPSIVLTQAVFFIIALLCNQIKLAKIKRQTKPANA

SEQ ID NO: 7973 - protein, 68 aa, Proteus mirabilis
GLNVGIVKISDELHEYLRKASNVMSRSVNAQAEFWIKIGIQAELNPEKTFPMIINEMLEKEAIKQEHK

SEQ ID NO: 7974 - protein, 150 aa, Proteus mirabilis
RENVMLSRITMLTTSFLLSGCMSSSVVPSKQLERPQPQVNIPTKVLTIKLDIGKTTQKETIALLGTPTDISSYDANLYGENMNVLESHIGKGYEYNSCDMGRAEKAKVVIKTLVVDKNAPDLEYIVECNTTRKTLSLSFFDGKLSQYSYY

SEQ ID NO: 7975 - protein, 92 aa, Proteus mirabilis
AFCVKKSRDLKIIVTSQYLAGNGYESLCLYFALPLSDNEPEWRVVEHWLKDGKRCLEHTELTYDLAQRTLITAKRGAKNLPLCQCIELNLIF

SEQ ID NO: 7976 - protein, 70 aa, Proteus mirabilis
RICVFNCTEYPKVYCLTLKLCRIKSIAPTNFTITYGDLLVLSNRIDYAVRIWIWLHRIFTRLLIFINIRL

SEQ ID NO: 7977 - protein, 233 aa, Proteus mirabilis
FGFVLSLGNNYTMFEKIIAAPADPILGLADSFRSDTRENKINLGIGVYKDETGKTPVLTTVKKAEKYLLENESTKNYLPISGIPEFGAVTQALLFGEQHPIITEKRARTAQAPGGTGALRIAADFIAQQTNAKRVWISNPTWPNHNNIFQTAGLEICQYDYYDAESHGLDFEGMLASLQNAQAGDVVLFHGCCHNPSGIDPTLEQWRQLAALSAEKGWLPVFDFAYQGFANGL

SEQ ID NO: 7978 - protein, 72 aa, Proteus mirabilis
KLFLILNGCIKLIQVRDDCSVIVKIDSMQLNNANKFPEFKYIISGQLKMKEISHTGKIIPFCHIKNMKHSVK

SEQ ID NO: 7979 - protein, 77 aa, Proteus mirabilis
SEIVGRSMLQENVVKDIIVWIEQNLDSRLSLDIIAEKSGYTKWHFQRLFKAYTGISLGKYVLARRLSCGRLCVEDHS

SEQ ID NO: 7980 - protein, 473 aa, Proteus mirabilis
VYQVLSSKLWEGSLMSDNVISSIGTNQTGVNNRVQLRKTLTLMQVVMMGLAFLQPMTIFDTFGIVSGITNGHVATSYAIALTAILFTAVSYGKLVKRFPSAGSAYTYAQKSMSPHVGFMVGWSSLLDYLFMPMINILLAKIYLQAIFPGVDPWIFVVALVALMTFFNLRGINVVANLNTVIVVIQVAVMVVFVGLLIHGVYNGEGTGELWTFRPFASVDAELIPMITGATILCFSFLGFDGISTLSEETPNAGNVIPKAIFLTALIGGLIFIAVSYFLQLYFPDISRFKNPEESQPEIMLYVAGALFQSIILVFSCVTVLASGMAAHAGVARLLYVMGRDGVFPEKAFGYVHPKWRTPAFNVLLVGFLALGAIFFDLVTATALINFGALVAFTFVNLSVISQFYIRERRNKGLMDHINYLILPIIGAATMGVLWVNLEPGSMELGLIWGAIGILYMVWITRRFRRPMPQMPEK

SEQ ID NO: 7981 - protein, 254 aa, Proteus mirabilis
YSFLIDASYQMVLFHFSEKFMRLDKFLSQQLGISRNLVARELRAGLVTIDGEMVKTGATKITPEQEIAYDGNVLTQILGPRYFMLNKPIGYVCSTDDPVNPTILYFIDEPLAHKLHAAGRLDIDTTGLVLLTDNGQWSHRITAPKHHCEKTYVVTLEQPIATDVAEKFKTGVQLNGEKELTKPATLEVITPTEVKLTISEGKYHQVKRMFAAVGNHVVALHRERIGDITLDDALAPGEYRPLTEEEINSIHLPK

SEQ ID NO: 7982 - protein, 414 aa, Proteus mirabilis
SILVIVMSLKRKIALGKNVLEAAQERVQWIFDTFEQITLSFSGGKDSTALFHLVAAQARKQHRKFNVMFLDWEVQYSATIDHIIKMKSIYQDCIERFYWIALPITTESGISQYEPTWTAWESGKKWVRQPPEDAITDPHFFPFYHPNMLFEDFTPAFNQWITGNHRSSIILLGIRADESLNRFIAISNNRKLRYADDIPWTTASAEGFYYMAYPIYDWHVKDIWTYIARFNLPYNPIYDLMHQAGVSLSQMRICEPFGPEQRKGLWLYHVLEPETWSLACERVSGADAGMLYTNPRNKSGFYGRHQISKPSHHTWKSYAHFLLASLPEKTAEHYRNKIAVYLRWYAERDYPNGIPDAQEGDTSTKQIPSWRRICKTILRNDFWCRTLAFSPTKSHCYDRYFKRIQGKRKDWQLI

SEQ ID NO: 7983 - protein, 333 aa, Proteus mirabilis
KRLVAALLGALHLSVFNIIRKINMTDFAMVFPGQGSQAIGMLAELAEHYPIVTETFAQASDVLGYSLWDLVQNGPEEELNKTWKTQPALLAASVAIWRVWQEKQGKMPQMMAGHSLGEYSALVCAGVIDFAAAIKLVELRGQLMQEAVPAGTGAMYAIIGLDNDAIAKACEDAAQGQVVSPVNFNSPGQVVIAGNKEAVERAGALCKEAGAKRALPLAVSVPSHCALMKPAADKLAVALQEIEFKQPEIQVVNNVDVKTQTDANAIRDALVRQLYNPVRWTETVEFIAGKGITQLLEIGPGKVLTGLTKRISKEMNAAAVNDIASLDAALGND

SEQ ID NO: 7984 - protein, 182 aa, Proteus mirabilis
AKIFGLRQFFGKIVDMLVYSYVVTVICMKYQQLENLECGWKWAYLVKKHREGELITRYVEKSAADEVVEQLLRLESQPLKVLEWINLHMNPELSNRMKQTIRARRKRYFNAEHQHTRKKSIDLTFKVWQRLSALSQRRGLTLSETIVQLIEDAERKEQYALKVHNLKDGLIELLERDKQKKE

SEQ ID NO: 7985 - protein, 195 aa, Proteus mirabilis
IRIFRCILPNSMSEDKMSYQHAGIYAIVKRVIGWLIFIPAFISTTVSLIELAAMPRANGEGVNAVINDFFRVLAEMVQFNTPWLDFFWRHSPVPNTQIGFSQQNIIFFVIFFLMFIGLALSASGLRMYRQVKYLKENIQDQLIIERALKSGITAQELEQNIKLPRHTLFTQVMVLYISPIIVIAIGYFLLKFLGW

SEQ ID NO: 7986 - protein, 110 aa, Proteus mirabilis
MRKLLSISAIALLTSIIATPALAAKTETYDCEGQKIRVSFPNDDLAVMDYNDELIVLKSAVAASGARYVGESFQLWGKGSEEFNLATMSEDEIVNDRIAEDTGRTCKIVK

SEQ ID NO: 7987 - protein, 151 aa, Proteus mirabilis
ILKLIRQFMFNYPATSHFDEESETYEITYRDFDNIHAVAYTEDDIELEASDILHVGLEEFISSKMPIPMPSEPQSGDFIVYLPPISCLKIALHNAMLTTKTKKADLARKMNLNSAQIERLLDINQTSKIDSLEQALYLLGYHIAISVHKQR

SEQ ID NO: 7988 - protein, 133 aa, Proteus mirabilis
SAFSLKCAPLYLFLDKPNLELVAGSPVTSMYFLFHKRKKMLTINATVRKEQGKGASRRLRVANRFPAIVYGGNEEPIAIDLDHNEVINQEHKSEFYADFVNLVIDGKATKVKVKAVQRHEYKPKITHIDFLRA

SEQ ID NO: 7989 - protein, 340 aa, Proteus mirabilis
VIVSYEVIAMPKTLMSLKQNDFTHKKIIVGISSCLLGDKVRFDGGHKCCHLAADELSEFFEYQSTCPEMAIGLPTPRPALRLVQSKTGEVRLKFSNGSEGDLTQLMNDYSIEYLRRFNQFSGYIVCAKSPSCGLERVRVYDPIGNGNKKSGTGIFTENLKRIMPWLPIEEDGRLNDPYIRENFITRVFALNELNQLKINNFTRQALIDFHTRYKLLLLAHSQPLYRQLGRFVANNKDWDSLETFFVEYRNRFMALLQHQATRRNHTNVLMHVQGYFKQDLTSKQRQALSQLILEYRQGIQPLLAPLTLINHYLSEYPDNYLSKQKYFYPYPQSLRLRYGL

SEQ ID NO: 7990 - protein, 71 aa, Proteus mirabilis
ICVSLKSLIASAGVKMNKVVYKVSGLWNETSFVNLFIATNEKEVLSAIILWAQFSGAKVDDLSIEYYSSVH

SEQ ID NO: 7991 - protein, 356 aa, Proteus mirabilis
SDELKRFYYCNNKERNVMGPVMLDVEGYELDNEEREILKHPLVGGLILFTRNFHDAEQLNELVRQIRDASHERLVIAVDQEGGRVQRFRDGFTRLPAAQSYAALNERYQASRLAQEAGWLMASEMIAMDIDISFAPVLDLGHDCIAIGERSFHECPEIAMDMAESFIKGMRSAGMKSTGKHFPGHGAVRADSHKETPRDERSLNDIRQRDMAIFKDFIQRQLLDAIMPAHVIYSQIDERPASGSPYWLKSILREQLGFQGVIFSDDLSMEGAAIMGSYAQRAQRSLDAGCDMLLVCNNRKGAVSVLDNLSFVKAERISALYHHRGRYTLSELQASDRWKKANQMLTQLQEQWQERA

SEQ ID NO: 7992 - protein, 590 aa, Proteus mirabilis
RQYSLINTEIFIDMVTRNQSYREKVSQMISWGHWFALFNIILSLLLGSRYLFIADWPSTFAGRLYAIVSWMGHFSFIVFAIYILILFPLTFVVVSQRLLRVISCTLASAGLTLLIFDIAVYQQFQLHLTQLVWDLVINPDEGEMAREWQLIFIGIPIIFLIEMLFATWSWQKLRSLNRQRWGKPLACVFISCFILSHSMSIWADANFYRPITMQRANLPLSYPMTARKFLERHGFINQSEYEQRLMSEGNPAAQSITYPLTPLDYSKDESSYNLLMIVVDGLGNEDVAKLPSLQQFADNNLSFSQHYSAGINNETALFGLFYGISPSYLDSVLSSRKNSALFDALNYRHYQLALFSTNGFKSPLFTQAVLADYSLPTSRSEDNDTTINSWRSWLLKNKQSTPWFSFLQINGDKHTSASQAQLNSQLETIFTTLKESNILDNTVVVVTSNYHQNNDKQDSQWLVSKDTFNLSQSQVPLVIHWPNVTPQKLDKLTSHQDIMTTLMQHVLGVISPADNYSQGEDLFANTRNHPWIFTGDNETLVVFLQDNTLMIDKHGRYALFDKSGKEIQSAKPDLRLLLQVLAEQKRFIER

SEQ ID NO: 7993 - protein, 216 aa, Proteus mirabilis
NTYSGVDVAKDFRDITLALAGICQASRLVQQIAYQGNADEKDVEVMVNSIFNINPTSTLDVYGNQISHLKLGFQTIKAIHQAVRREKLTFELMTYQQGLINLERIINKNNDYSSHLSQKISQLERQKNYFEPLSDGLFNALAGVYSDAVSPVGPKIQVNGSIELLKNPIIQAKVRGLLLTGLRSAVLWRQVGGRRFDFLLHQKTILRQTDDFLAQC

SEQ ID NO: 7994 - protein, 72 aa, Proteus mirabilis
YQHSLYIHIQGTRIDFVTAGFPLLYDHSKRTSDWCRRVVLPVPDLLARAACTQADGAFHTSPAPVLSGLNQI

SEQ ID NO: 7995 - protein, 137 aa, Proteus mirabilis
MVDSEIYDILRSVKTIALVGASHKEDRPSYKVMKFLLEQGYEVIPVNPGMAGETILGQQCYGHLQDIPVAIDMVDVFRQSSVALEIAKEAIKINAKVLWLQIGVINEEAKALAEQSGLRVVMDRCPKKEIEAHGLPW

SEQ ID NO: 7996 - protein, 202 aa, Proteus mirabilis
VMASEIEICNIALSRIGNSRSINSMTEASKEAVQCNLHYAQCRDSVLADFPWNFATKKVALANTNNPPPNWAYAYRYPNDCLKAIGIVEPHQKYRRPDTAIHFHVGSDENGTGRLIFTDHPSAWLEYVARITDVNMFDALFKDALAWRLAAELARPLASNAGIGGEALQIYQGVIKSAAAHSLSESAEPTDYMDEFTQARLS

SEQ ID NO: 7997 - protein, 512 aa, Proteus mirabilis
SMPLLQDDSSSPRPLEIAAIDLGSNSFHMIIARVVNGALQVLSRLKQRVYLADGLDDNDKLSEEAMLRGLSALSLFAERLQGFPAENVTVVGTHTLRVASNAKVFLQRAKEVMPYPIEIISGHEEARLIFMGVEHTQSEKGRKLVIDIGGGSTELVIGENFEPILIESQRMGCVSFSRQFFPNQKISESAFRKAREKAARKMEKIAWQYKMTGWDVALGASGTIKAAHEILVEFGEKDGVITPERLLMLTKQVLRFKKFKDITLPGLSDERKHSFVPGLAILCGIFDTLGLKALHLSDGALREGVLYEMEGRFRHQDIRQRTAKSLAEHYNIDREQAKRVLTTMQSLYAQWAEQNPKLVRPDLEAILVWAVMLHEVGLSINLSGLHRHSAYILSNTDLPGFNQEQQQLLTTLVRYHRKVIKFDELPKFNLYKKKQYYPLVQILRLATLLNNQRQSTTKPVSLRLVTDDNHWTLYFPKNYLADNTLMELDLEKEQEHWQAVPGWKLDIKEESA

SEQ ID NO: 7998 - protein, 289 aa, Proteus mirabilis
TCRLFVDNPCSPSLIIDDTHMLISSSVNQMAQLQPCRYSGFILSIVFHFTLVISYFYITQQRPVIIHQPAPAVMLSLSENVQAVNKEKQIVGVDQQMAVASQKKQQQEIAEKQPNLIINENADILLEKPKKVLQNQTSVKVAPSIAPTKPSPIVSENVSSLSAPSTSHSVAKQQANDVSANYDSDANKEADALALWQAKAKGHLNRYKAYPEEAKRKGRTGAPKVRFIVDGQGYVIACELINSSGVRSLDKEAQSVIKRAQPLPKPPEELLFNGQITIEMAIEFSTLTL

SEQ ID NO: 7999 - protein, 234 aa, Proteus mirabilis
SHLSADHGADYFMITPLMLTGRSTDHLVTLSERHHLQFNATKAFLALQQQAAKAGFKLMPASSFRSFERQLAIWNGKFEGTRPVLDAESQPIDIQTLSEGQRCEAILKWSALPGASRHHWGTEIDFYDPFRLPNGQSLQLEPWEYEQGGYFAQLNDWLTENMSAYDFYRPFTDKESYIAYEPWHISYLPLSYEASQAYTIDILRAVLEEEPILGKQWLLDNLETVYQRYIVLPE

SEQ ID NO: 8000 - protein, 223 aa, Proteus mirabilis
GLISLINTLVISQVEIFSLGIEKLLCQIKKINIRKIMNDESEAFRYCRQYSVNLIIFYSLPTVSLIDVIKRIKRFSPIIKIVVISPKIDSILSVTLLQLGIEGFIVIDSSAANVLQAIRQVCIGQRYISPEIAMDIALTKVQADLNPLHHLSERELQIMSMIIRGKKIAQIAQELNISTKTVNSYRYRMFSKLKISGDVELTHIAVRYGLIEIESYLQSGKHI

SEQ ID NO: 8001 - protein, 257 aa, Proteus mirabilis
RRKSSVMDHVIYTAMGGARHSMENQAVVANNLANASTPGFKAQLSAMRAVPINGETLPTRTLTVASTPGSDQRQGTMNYTGRPMDIALSDNGYLAVQLEDGTQAYTRNGNIERNADGMLMVQGRLLMGDNGAIEVPPQAEISIANNGIVTAHVPTDPPKMLGQIGRLKMVKPEQNDLVRGDDGLFHLSPQGTARVGETLPADDNVKVLAGVLEGSNVNPAEAMVDMIANARRFEMQMKVIHSADDNAQRANQLLSMS

SEQ ID NO: 8002 - protein, 415 aa, Proteus mirabilis
LAFFTIFATRKHINTFDLMTIVFRQRYYRSVITNLLIKNFQIKLKEYCMAQVINTNYLSLVTQNNLNRSQSALGNAIERLSSGMRINSAKDDAAGQAIANRFTSNINGLTQASRNANDGISVSQTTEGALNEINNNLQRIRELTVQAKNGTNSNSDITSIQNEVNQRLDEINRVSEQTQFNGVKVLSGEKSKMTIQVGTNDNEVIEFNLDKIDNDTLGVASDNLFDAKTEKKGVKATGDAIDANALGISGGTKYATGVSVKEYKVDGKVSANKVVLKDGSDEYVVSKSDFTLKSGTTTGEIEFTGSKTIKFKADAGKDVKVLNVKDDALATLDNAISKVDESRSKLGAIQNRFQSTINNLNNTVNNLSASRSRILDADYATEVSNMSKNQILQQAGTAVLAQANQVPQTVLSLLR

SEQ ID NO: 8003 - protein, 110 aa, Proteus mirabilis
VTRSISETARPTCEIPRLCSSDAEAISPIISVTRVTDSTIRVMVSPALSTNTDPVSVRLTESSINVFISLAASALLCARLRTSPATTANPRPCSPALAASTAAFNAKILV

SEQ ID NO: 8004 - protein, 349 aa, Proteus mirabilis
HVMSEAIRLTQYSHGAGCGCKISPKVLETILHSEQAKFHDPHLLVGNETKDDAAVYDLGNGTGIISTTDFFMPIVDNPYDFGRIAATNAISDIFAMGGKPIMAIAILGWPIDKLAPEIAREVIEGGRAACQEAGISLAGGHSIDAPEPIFGLAVTGVVPVSKIKKNSAAKAGCQLFLTKPLGIGVLTTAEKKGLLKPEHQGLATEIMCRMNKAGTDFSDIEGVTAMTDVTGFGLLGHLSEICEGSGLQATIHFSQVPRLPEVEAYIEQGCVPGGTGRNFESYGHLIGNISEMQRKLLCDPQTSGGLLLAVQPEAVEQVKEVAKRFNIDLTSIGELTEPKAGRALIEVTN

SEQ ID NO: 8005 - protein, 162 aa, Proteus mirabilis
LSMSNYSNERKSYSLILIILLLVIAIIAAAFGGYSWWALKHAKSGTTGTSQQKVIPAPVFMSLEPFTINLIDEEEHLDRVLYIGITLRLHDENTRKRLHDYLPEVRSRLLLLLSRQHANKIATDAGKQQLMTEIKETLRPTLVPGESEQILSDVLFTTFILR

SEQ ID NO: 8006 - protein, 468 aa, Proteus mirabilis
IVSSCCTGGVVMTARLGRWLEKLADAESRLNKIPRIRQYGRLTRATGLVMEAKGLVMPLGSTCLIERTIGKTVEEVESEVVGFNGSQMLLMPLQEVEGLTPGARVYAQSIPGREGEGRQLPLGDALLGRVLDGSGDPLDGLPPPDTSYRAPLITPPINPLQRTPITDVLDVGVRAINALLTVGRGQRMGLFAGSGVGKSVLLGMMARFTQADVIVVGLIGERGREVKDFIENILGKEGLARSVVVAAPADVSPLLRMQGASYATRIAEDFRDRGKHVLLIMDSLTRYSMAQREIALAVGEPPATKGYPPSVFAKLPALVERAGNGVDGGGSITAFYTVLTEGDDQQDPIADSARAILDGHIVLSRSLAESGHYPAIDIEASISRAMTSLIDKTHYRRVQVFKQLLSSYQRNRDLINVGAYATGSDPMLDKAIALYPSLAKFLQQDIQEQCSYQHACEQLNQLITLDSF

SEQ ID NO: 8007 - protein, 205 aa, Proteus mirabilis
DLTLTHVGVQMSQERLYIDKEISWLAFNERVLQEAADKRNPLIERVRFLGIYSNNLDEFYKVRFADVKRRILINEERGSRSGSSHARHLIKKIQSKVAKADQEFDALYNDLLLEMARNQIFLINERQISPNQQIWLRQYFRQNLRKHITPILINPETNLVEFLKDDYTYLAVEIAQGQTIHYALLEIPSDKVPRFVILPTETRPR

SEQ ID NO: 8008 - protein, 518 aa, Proteus mirabilis
  UNSURE (23): Identity of amino acid at the above locations are unknown.
RSPPIKSLVLLFCPQKQGRGKKXSMILLDNILRYCLDEIFKGFFDYDSLNAYSMKMTRDAEYDLATEMESSLLEMMSSTLKQRLTAEPVRFVYQRDMPDEMVALLRSKLGLSNNDSVIAGGRYHNFKDFINFPNEGSKFLLNKPIPRLRHVWFDNFRNGFDAIRERDVLLYYPYHTFEHVLELLRQASFDPSVISIKINIYRVAKDSRIIDSMIHAAHNGKRVTVVVELQARFDEAANIHWAKRLTEAGVHVIFSAPGLKIHAKLFIISRLEEGEIIRYAHIGTGNFNEKTARLYTDYSLLTANTEINNEVRRVFNFIENPYRPVTFEHLMVSPQNSRILLNQLITNEIHNAQAGHPAGITLKVNNLVDEELVNRLYDASQAGVKIRLLVRGMCSLVPNQPDFSENIQVTSIVDRFLEHDRVYVFTNKGDEKIFLSSADWMTRNLDYRIEVAVPLLDPQLKQRILDILEIQFNDTVKARYLDKDLTNSYVPRGNKRKIRAQLAVYEYLKSLEQPGSRA

SEQ ID NO: 8009 - protein, 770 aa, Proteus mirabilis
FGDPMSNGITLRVKGKVQGVGFRPFVWQLAHHFGLLGQVSNDSLGVLIHLTLSPQNQHFINALTAQCPPLARIERIEQTPYQWEQLPTNFTIVKSGGGEMDTQVVPDAATCQACIDELFDPQNRRYHYPFINCTHCGPRFTIIKKMPYDRPFTSMSAFPFCPTCQHEYQDPADRRFHAQPNACPVCGPHIWLADHQGQQLAIKERALTQACQALLAGKIVAVKGIGGFHLVCDARNSESVARLRARKHRPAKPLAVMLTGTEQLQKPGDNAEFYSKVIETLTSTAAPIVLIPKEIAPTSLSELIAPGLTEVGVMLPANPLQHLLAHETQIPLVMTSGNATGHTPALTNEEALTQLGDIAELFLMHNREIIQRADDSLVRIEDDQCVMIRRSRGYVPDAIALPTTFDAQPAILALGGDLKNVFCLLKEHQAIMGPHLGDLDDLSVRQQLLKSLTLFQQIYRFTPKAIAIDAHPNYISHQIGKQLAEQQQIPVIEVPHHHAHIVSCLAEHGHTQQQGAVIGIALDGLGYGQDGSLWGGECLLVDYKKSQRIGGLPAVAMPGGNLASIQPWRNWFAHLATFTKDWQGSVITQAIPLTELQILSKAVARGLNSPLASSCGRLFDAVACSLGLSPKQISWEGEAACYLQSAALQCHVDRYADIIKQYGHLMSVKDKHVDLSIFWSQWESITLNTSEKAWLFHYLLAESLGDIALQAAQEHQIDTIVLTGGVFNNILLKDLFKQKLNNKKVLTPMILPSGDGGIALGQALIASHFM

SEQ ID NO: 8010 - protein, 80 aa, Proteus mirabilis
NNMLPFINNMISSASSHWGVACLKINLIILRSLYQHTRLFLFSVVQTPLFGWQDHRHIIVLLWLGVNCVYMETPQPRLLL

SEQ ID NO: 8011 - protein, 79 aa, Proteus mirabilis
ICPPISWIFRFTTSIPTPRPETSVTTSAVEKPGANINIATSSLLIFSETAKPDDIAFFKIRSRFNPAPSSVTSIQILPP

SEQ ID NO: 8012 - protein, 77 aa, Proteus mirabilis
KTPPEINCKTPNNRRMDNNPVTIFIRLNMSFPFYNRWYDQVIGRLKRNFIGFILYRYYFLSTINKLNINKLYFKFSF

SEQ ID NO: 8013 - protein, 66 aa, Proteus mirabilis
PPYPFNQRRNTMALCDSPYKDRVLTEEQKQDCSYCDYCDVEILDDDVVFVGGDTVYCCEQCFVDSQ

SEQ ID NO: 8014 - protein, 157 aa, Proteus mirabilis
VMNPLKAGDKAPQFSLPDQDGEIINLSDFAGQRVLVYFYPKAMTPGCTTQACGLRDEMDTLKKANVEVLGISTDKSEKLSRFAEKEMLNFTLLSDEDHKVAEQFGIWGEKQFMGKTYDGIHRTTFLIDKNGVIEHVFDNFKTSNHHQVVIDYLAAHP

SEQ ID NO: 8015 - protein, 67 aa, Proteus mirabilis
IPSFSVIVLYSTFVDIIPTILIKHINKLYCCGDNLYLYSQSIIFYIHKVLSRMLRSNFPINCTDTFF

SEQ ID NO: 8016 - protein, 194 aa, Proteus mirabilis
RFPLVKENMKSISLSLILLLLSTFSWANEDEDSKKVDEYKTALQAFFNSDYLLCLGEGKWPVYSNENDAPWVLERMNALMDAGLIEQTVDGDEWVFSLSEKGRKAWQPYQDFCYGHLFISQIKEIQPIDSDKSTIYFYYGVKDIPAWARNSDVQSAFSELDIVINGINRELYQLKIEKLPDNHFKVLSYPVPIE

SEQ ID NO: 8017 - protein, 364 aa, Proteus mirabilis
SDPFTQCARCDPNRSHVDITSDGKCGLFTGEIGDYLMKELSLLSSMPNISTPAYDSNALNKLKYQVGQNADQQGLRQVAQQLEGVFVQMMLKSMREAIPQESMFNSESTKMYTSLYDQQIAQDLSKKGLGFADMIEKQLSAKVTMEPSELAGKTPMPLDSSDIFQSMPTQALGQLYRAMQPLQNAVESTVGKLKGLSESSASFAAKLLGPAKQATQGTGIHHLLVVAQAALESGWGKREILTGDGKPSYNLFGIKAGRYWKGPVTNIMTTEVIDGKSIKMRDNFRVYGSYVEAIQDYLRLLTESPRYAKVPQAKTPEQAAYHIQEAGYATDPGYAKKLVSIIGQLKGQGEQVAKTYTHDLSELF

SEQ ID NO: 8018 - protein, 62 aa, Proteus mirabilis
RYMPFVHISMRYVRENLTFTRQNPVAFIDSEGEVISASKKEFEQLTDGNHIGFDIPLIQQFK

SEQ ID NO: 8019 - protein, 1129 aa, Proteus mirabilis
KLMPIYEQQPDDILSADINAVQQPEPTYGDNVSQSWYDPINPLDDRRQTKELRDAAFRIDNSVGSLIATAPFNQFEDVEGYNPFEDELTLSGYEDYADAFIHSNSPQETAAIKQRIDRERNDKQMLADAGGAGVVSSIAMGVIDPINVAAMMIPGGAIVKGGSVTTTAGKFALANTAGGVASEMALHSTQETRTLTESAINVTLDAMIGGTLGSAAQLVKNRGELVTKVRNDLIGEQQSGQQNIPNNIPDNSSVGAMEVPNTTLEQETLKGPSFINRTMNVSPVGRVAQSPSKTARQINQQLTENNFTFAKNEEGIATFTAVETKVRGYETLVYKQVESTKDHFKQYRQSGGRDMSYYQFSEAVGDAMRNGDTHAIPQIAEAARSIRPIVEATKDRMVELGILREGVKVTTAQSYFPRIYKFDKILNDRTEFKKIIADWLEEINQTSINKAKGSLDRAEIGIDKARNASPQAERLGLEIKEADSWSGKKSLLMDDINKYQKIINEKSAVEVELNSLSNLAKLNKTQTRRQATLQRKLQRINDAENKLPALQRSVDILDNPRKFRNEHRRLTRTANSLTRHDRIRQSALNRMTPLEREELDAAADDIVNKIIGAPSGIVPSELIPDGLVKRAGFTKDRTLNIPDERIKDYLESDVNYVMENYIRQVAPEIELTAKFGRVDMDNQIKAITEEYNQLIADATTPKERSRLEARREADLRDIRAMRDRLLGTYGAPKDPSSFFVRAGRVARHVNFLRLLGGMTISSLPDMARPIMQHGLRSALKPLGKMLTDIGAMRIAKADLREMGIGLEYVLSSRSKVIADLSDPYSRRSYLERGLQWSSQKFGNLTLMNQYTDTMKMWSGVITQSKVLRAANTLDAGGSLSKREIKKLAHIGIDESMLKRIADQFKRHGEDLDGMLTGHSHLWDDRVVRETFQAAVLKDVRTTVITPGIGDTPLMMSSELGKIVMQFKTFFFATHNRALVSGIQSGDASFYYGALLQVALGSLVYILKAKMAGRDINTEPANLVKEGLDWSGMMGWLGEPNNVLENLSGGTYGMSAMFGGPPASRYQSRNGIGALLGPTFDLGGDIKNITSGVLNGEFDDREVRSVRKLLPFQNLFYLSPLLNQVEEQMK

SEQ ID NO: 8020 - protein, 204 aa, Proteus mirabilis
GLKFIFLIAIITKEVMIMTIKRPRKKPARQPMPINDKMERFCQEYIKSPDNQTDAAISAGYASGSACKRASQLMADPRIQERIAQLMQQRNKRTKMSADNVLKRLVDMLDADIADILNDNGDIKPIKDWPTVWRKSIASFEIAVVDENVTVKKVKLLDKLRVLELVGKHVDVNAFRDRVQVDVNVSLADKLASARKRAQQGSVE

SEQ ID NO: 8021 - protein, 62 aa, Proteus mirabilis
RLITPLNETQKANNETPESRFIYLRKGSLFCYATLLVFIPNYKARIVYECRKNRRCEPEKRF

SEQ ID NO: 8022 - protein, 188 aa, Proteus mirabilis
QENTKMDALTLLLNRRSASRLTTPAPNNQQLEAILQAGMRAPDHGALKPWHFVVMKEDGIERFSQLLHKAAVVSQLGAEVEEKAKNAPFRAPLIITVIAKVKAHPKVPEWEQIVAAGCCVQAMQMAAVAQGYSGIWRSGSWTHDPVVRAGLGCGEHDHIVGFLYLGTPALKAPTTVSPADLTDFVTYF

SEQ ID NO: 8023 - protein, 236 aa, Proteus mirabilis
TMTTTTSTYSILIVEDEPKLAQLLIDYLQASDYQTQWLADGTEVIQHIKQSHYDLVLLDLMLPGKDGITLCKELRQFSDIPIIMVTAKTEEVDRLLGLEIGADDYICKPYSPREVVARVKTLLRRYYRPQDIVQNSALVIIDEQAYQIQYHNKILDLTTAEFRLIKALATQPGKVLSRDQLMDHLYDDYRIVTDRTIDSHIKNLRRKLEQLNDQIEFIRSIYGQGYRWETAAYRFR

SEQ ID NO: 8024 - protein, 233 aa, Proteus mirabilis
HYDTNFFNITRTTAMPYSELYMSSTYFHSSLLAATLFSVTLTAPAFASENTQNTPQTITTKKPQPAENTFSEKNEESYWGKFKRNLTQTWDNDQYNYYLPVWTWHNRFTYDKEKTNRYNETPWGFGMGKYRYDNEGDWHGLYAMAFMDSNNRVQPIMGYGFEKMWYPGGDREGFRMGAGFTLSVTARHEYNYIPMPLPLPLVSVGYGHLSLQATYVPGTYNNGNVLFAWLRWQ

SEQ ID NO: 8025 - protein, 62 aa, Proteus mirabilis
DNSTSILFLAGAQTVTEPGHCSINIPANADFPLPRGAVILHTPDFTCKRCANNCCCCMVGIP

SEQ ID NO: 8026 - protein, 73 aa, Proteus mirabilis
LYVTNNNIYYAKTTFPIPTTSVVVRRKNGPKLRSVFYMVPRAGLEPAQPKGRGILNPLCLPISPPGLNSVVRP

SEQ ID NO: 8027 - protein, 218 aa, Proteus mirabilis
SKVTPVKNSALLLVDLQNDFCTGGALAVKESDTVIDTANRLIDYFQRHQRPIIASKDWHPADHLSFAKNSGTVVGEIGQLNGRPQVWWPVHCVQNSHGANFHPLLTDDLISHIIYKGQNRLIDSYSAFFDNDHEYQTGLHTLLQSMQIEHLTILGIATDYCVKFTVLDALQLGYQVSVVMDGCRGVNIQPDDSQLAFNQMQQHGAVLVDSVTVLKSDK

SEQ ID NO: 8028 - protein, 80 aa, Proteus mirabilis
VTQTMRRMLQQKIIQVCDTKIAQKGEGVGLSFYAFFANKNDDPELLMEAATWWIMTHKLDHFEKATKIKKMIQTEMDANR

SEQ ID NO: 8029 - protein, 78 aa, Proteus mirabilis
VVKTNRVARRILGLPYNLSRSKKKVRFSIITPTESDNLPAELKNATRICLKQDFRKNAQNKRIYMKLTDAYPDYLLVS

SEQ ID NO: 8030 - protein, 98 aa, Proteus mirabilis
YTETRRATMKCETLLTIVNAIICTVIFLRVFYFKRDGRQHCKKGGWLAFLILAYSSSVPIRAYFDPNYHADIYNIFANILICTTLLVSKGNVIKFIKG

SEQ ID NO: 8031 - protein, 86 aa, Proteus mirabilis
FAETSLACCFATEWLVEGADKLDTFSLTIGEGLVGAIEGATLTEVWFCSTFFGFSSKISAFSLIIRLGCFSAISCCCFFWLATAIC

SEQ ID NO: 8032 - protein, 218 aa, Proteus mirabilis
PAVTFIVSPFSLFIQCIFTEVLMSGGKKVPPIKLRPLEREDLPFVHKLDNNASVMRYWFEEPYEAFIELSDLYEKHIHDQSERRFIAESEGTKVGLVELVEIDYVHRRAEFQIIIAPAHQGHGYAARAAKLAMDYAFSVLNLYKLYLIVDKENAKAIHIYEKLGFKKESDLIDEFFVNGSYRSAIRMCTFQAPYFEQKAKAARPENFVKPGATIKQYV

SEQ ID NO: 8033 - protein, 386 aa, Proteus mirabilis
IGQTVAEDSDLEKTEEPTPHKREKAKKDGQIVRSKELSSVLMILGGVSLLWMSGRFITRELYAMLTEGFTFNHHIIGNENLLIPRFASLMKQAVFALSPVFLGLVLVAIGGSAVLGGINFSSKSIKFDPKKWNPISGLKRIFSMNALAELFKAILKSLFVGLAATVFLWHNWNDILHLITLPPLSALANAMQLLIFAVYIAVFMLIPMVAFDIIFQIRSHLKKLRMTRQEIKDEFKQQEGDPQLKARIRQQQHEMSRRRMMADVPKADVIVTNPTHYAVALQYNDKMVAPKVLAKGAGAIALKIKEIGAEHRIPLLEAPPLARALYRHSEIGQAIPATLYAAVAEVLAWVYQLKRWKTEGGLKPKQPMNLPVPPALDFAGEDNRHG

SEQ ID NO: 8034 - protein, 69 aa, Proteus mirabilis
SVETLNVDLKAVLMHPFLYSPVSIIVAKSLKSRDRQLLSIRSITKCYITTTEKFKRIFLAKIGLYLSQY

SEQ ID NO: 8035 - protein, 123 aa, Proteus mirabilis
KAWTANMDIMAAYEQVLKLSEQMLTLAKNQQWDQLIEMEMDYLKSVEIITKMIKPTEGELIIQQQLTNMLKKILENENETRNLLRARLDKLAVLIRQTEQEQRVQNSYGQFSEHSYYPDLNLK

SEQ ID NO: 8036 - protein, 101 aa, Proteus mirabilis
KFSAYAKGNSRSKPLALQGVLRDLNAPQSIYLARKLMRDDYLVALQFHSIDEVKVKNKINSLILYKKWQTEKSILVDCCFYVLAKCVIKIKMPILRTIKKK

SEQ ID NO: 8037 - protein, 277 aa, Proteus mirabilis
SSVAVYITILHMGGSMYHDLQGKVAVVTGSSRGIGAAVVTRLVQEGMNVVINYHSDENEAQALADSLNRHGKGKAIIFGGDISDEKIAHNFIYKAIDHFGQLDLLINNAGIETQTPSHAVNLEDWRKIIDINLTSYFLTARSALKYFVENKIKGNIINMSSVHEVIPWPTFASYAASKGGVRMLTQSLALEYAHYGIRINAIGPGAINTPINKEKMQDDALRKELEEMIPMKYAAEPEAVANVAAWLASEQSTYITGQTIFIDGGMTLYPSFQGGKG

SEQ ID NO: 8038 - protein, 219 aa, Proteus mirabilis
KDYAYYFLGRGVMPSYSIMIVDDHPIMRYGLRLLLEQDKEFIVVSESGNAQEAITTAKQLNPDLIMMDLHLQGRSGIDIIRSLRRCGLTSYVLVLSISDSRNDVYAALDAGANGYLLKECELDMLLLSLRKAVVGRPVYSEKVWQYIQLRQNYSDPLSALTKRELDVLQEVAVGMKNKQIAENLFISEETVKVHIRNILKKLQVTSRLAASLILIKHQH

SEQ ID NO: 8039 - protein, 110 aa, Proteus mirabilis
MINAEVYMSIPAIESVLDKMQIQTLQASNIAKPQPVQAGFATQLVQAVGKINETRVNATNKVQAFTLGTPGVELNDVMVDMQKSSISLQMGVQVRNKLVAAYQEIMSMQV

SEQ ID NO: 8040 - protein, 61 aa, Proteus mirabilis
VKRAIIPNRTLFPTPEPAKSPIRWPRPTVSSALMARTPTSSTSVMGVRCNGLIGGVISGAR

SEQ ID NO: 8041 - protein, 367 aa, Proteus mirabilis
RNLAMAQVINTNYLSLVTQNNLNKSQGTLGSAIERLSSGLRINSAKDDAAGQAIANRFTSNVNGLTQASRNANDGISIAQTTEGALNEINNNLQRIRELTVQAKNGTNSNSDITSIQNEVKERLDEINRISEQTQFNGVKVLSGEKSEMVIQVGTNDNETIKFNLDKVDNDTLGVASDKLFDAKTEKKGVTEAGAAIDAKDIGVAGATSYDSGTVKEYKVDGVVSADKVIFNDGTKDYLVNKSDFALEGADKAKFTGAKTTEFTADAGKDVKTLNVKDDALATLDKAINTIDESRSKLGAIQNRFESTINNLNNTVNNLSASRSRILDADYATEVSNMSRGQILQQAGTSVLAQANQVPQTVLSLLR

SEQ ID NO: 8042 - protein, 253 aa, Proteus mirabilis
FLKAHLVYRKPQQGQLAMVLVQAMTQGIQRGLFSNEACMGSAPNAAASATPYPPHPASQGYIQMLGVFMDTLVICSATAVIILSSGVLDNYQDGINGIQLTQLALSSTVGGWGSTFIAVAIFFFAFTSIIANYAYAESNMIFLGRNHMTGLFLLRSAVLAMVMFGALAEMPLVWKMADLSMGLMAVTNLIAIILLSGVALKLIKDYNQQRQAGVLPTFNIRQYPELQNDIEQGIWDKEPLPNEPLVRCEKVRQ

SEQ ID NO: 8043 - protein, 351 aa, Proteus mirabilis
HLNLKKGYHQRLLFNITDLAKYINPMKLNDELTNSIASVTEAAAIAAMPWVGKQDKNAADAAAVAAMRERLNSLNINGQIVIGEGEIDEAPMLYIGEPVGNGQGEKIEIAVDPIDGTRMVATGENNSLAILAAGFEGSFLQAPDMYMEKLVVGKKAAGVIDLNHCLEYNLDAIAQTLNKSLSQLTLAILDKPRHHDIIIDLRNRGINVITLPDGDVLASLYATMPNNPIDVMYGIGGAPEGVISAAIAKALGGDMQARLITRDIAKGNNATNREIAAQEISRCHNMGTDVNITLPLEILVRHQDVMFAATAITAGDLLSGVTEQSDYLRTHSLVINGSTHSLRYIENYHLR

SEQ ID NO: 8044 - protein, 483 aa, Proteus mirabilis
GLFYEHRKETSMAGISALGIGAKMPLGETLMQLEAAENKRLEPLDKQMKSYDAQITAYGKIRSQLDKLQKASEELKKFDKIVATKVDDEFDAFKVTTDGKASIGNYTVSVTELAHAQTLKSKAVSDIKDPIGETLGEGKTRTLVITQKGEKEPLKIELTDSQTSIIELRDAINKKEGNVSATIVKAQDGVNHLVLTSRKEGTDSQMEITVEGDSKLNDFISYSTKTNSGAMTEIVKANNAKLTINGIEIERQTNEIKDAPEGITLNLKKKTNDNKDGVDKPEIITVARDIEPMKKAIKAWTDAYNELNKTYKDFTKYTQVEKGEDASKDNGVLLGDTTSRMIMSELKSFITRSQSSSEIDTLNKMGIKFKVDGTLEVDDKKLDKALKEKPANVKEFFMGDGKETGFGTQTYNYLKKTLQSNDGTLDIATDGVKKRKKSLDNQIKNTKRTIEATMERYKKQFQLLDKMVNAMTNSSASIERLLR

SEQ ID NO: 8045 - protein, 241 aa, Proteus mirabilis
LSFYKSVMLYYNKISWVVLFMWIANFKNFSWRAVPILMSFFLLMTTPKVLAHPHSFIDMQTTFNTQDDKLIGLTFSWVMDPITSMDILYDIYNAQPESDIWKKQAARLMSNILSQNYFSEFYMDGKKQKFRRIPSHYTLIKEKLQVKFSFDVLFITPLPFAKHHFELLTYDPTFYVSMTYRDNTQIIWPLEMIADCKHKLIEPFADESLKEYAQSLDINGSTDSDLNLGLSFTQRVQVLCQ

SEQ ID NO: 8046 - protein, 227 aa, Proteus mirabilis
HKLYKVIQTMSVRTFIGVISFFFIVNSGIANPLPEALQQFFQTRHHKDDKVTVTVLTPEDKWPHCRQQEILQHAGSRNWGRLSIPIQCDNQRRFIQVDVSVYGQYLVAKKEINRDDVITKSSIKIIKGDLEKLPYDVLRDAVFIKNAIAMRHIATEKPITSTMVRRPWAILAGQTVTVFAQGDHFQIRYEGKAINNAVANESIRIRVKSGQIITGEALENGSVRIPL

SEQ ID NO: 8047 - protein, 772 aa, Proteus mirabilis
PSPYPIDTKDMKMEDKLQQSALDFHEFPNPGKITVTPTKPLITQRDLALAYSPGVAAPCLEIAANPLAAYRFTAKGNLVAVISNGTAVLGLGNIGALAGKPVMEGKGVLFKKFSGIDVFDIEVNETDPDKLVDIIASLEPTFGGINLEDIKAPECFYIEQKLRERMNIPVFHDDQHGTAIISTAAIINGLRIVRKNIDKVRLVVSGAGAASIACMNLLVALGLKRENIVVCDSKGVIYQGREANMAETKAAYAIKDNGSRTLDDVINDADIFLGCSGPGVLTQEMVKKMARDPLILALANPEPEILPPLVKAVRSDAIICTGRSDFPNQVNNVLCFPFIFRGALDVGATAINEEMKLACVHAIAELALAEQNEEVASAYGDQELSFGPEYIIPKPFDPRLIVKIAPAVAKAAMDSGVATRPIEDFAAYIEHLNEFVYKTNLFMKPIFAQAKKEKKRIVLAEGEDNRVLHATQELVTLGLAEPILIGRPSVIEMRIQKLGLHIQAGRDFEVVNNENDPRFKEYWQEYYQIMKRRGVSQEQARRAVIGNPTLIGAIMVRRGEADGLICGTVGSYSEHFEIYKNVFGLREGSNTAGAMNALLLPSGNTFITDTYVNEDPTAEQLADITIMAADTIRRFGIEPKAALVSRSSFGSFDSPSSIKLRKALELIKQRAPELEIDGEMHADAALVESIRRDIMPDSPLKGSANLLVMPTMEAARISYNLLRVTSSDGVTVGPVLMGVAKPAHILTPIASVRRIVNMVALAVVEAQTQSQR

SEQ ID NO: 8048 - protein, 191 aa, Proteus mirabilis
VKFLPMTLIDTFINRFQLTLPEPVNQPIDAKKSAAVLLPIINKPNPTILLTERASTLRSHAGQVALPGGKRDPQDKSLIETALREAHEEVDIPPSMVSVIGQLAPLRSSEGYLVTPIVGVIPPNLSLRHNPTEVASVFEMPLSYVLNTQRYLPLDFRRAGKMHRIYFYPYEGHLVWGLTAAILHNLALHIT

SEQ ID NO: 8049 - protein, 615 aa, Proteus mirabilis
RVTYKVENIFDAKAFLSRVTSQPGVYRMYDASGTVIYVGKAKDLKKRLSSYFRAQVNSRKTEALVKCIANIDVTVTHTETEALLLEHSYIQRYQPRYNVLLRDDKSYPYIYLSADKHPRLASYRGAKHAKGEYFGPFPNSLAVRETLALMQKLFPIRQCEDSVYRNRSRPCLQYQIGRCLAPCVKGYVSDEEYAQQVNYVRLFLSGDDSQVIEGLIKRMEEASQALRFEEAARIRDQIHAVRQVTEKQFVANIGDDLDVISVAFNGAIACVYVLFFRQGKVLGSRSYFPKVPANTSLDEVVQTFIGQFYLQGSAIRTLPTEILLDFNLEDKTILAESISSIAGRKIHIQTKPRGDRARYLKLARTNAATALATKQVEQSTISQRYNSLMSLLEMKEIKRMECFDISHTMGEQTVASCVVFDMNGPLKSEYRRYNISGITPGDDYAAMNQVLTRRYGKSLEESKIPDIIFIDGGKGQLAQAIDVFQSLDVDWDKSHPKLIGVAKGSDRKAGLETLFFKPEGEGVALPSDSPALHLIQHIRDESHRHAITGHRQRRAKVKNTSSLESIEGVGPKRRQMLLKYMGGLQALRDASVEEIAKVPTISTALAEKIFNALKH

SEQ ID NO: 8050 - protein, 135 aa, Proteus mirabilis
YQYYVLSYKENIMSTTNLTYTMYGIKNCDTIKKARKWLDDNHIPYVFHDYRKDGLKEALLLTFTENLDWQTLVNKRGTTWRQLSDEEKNAITDVNAAIALMLDKPAIIKRPILVSSDNRFMVGFNANDYLTFTGA

SEQ ID NO: 8051 - protein, 127 aa, Proteus mirabilis
CSSYLRCCNSIRCDMSRYKVLKKSFIAGRLLEIGEEVEYDGIAGDNLALIGGADARLNTHSVADGAGDNTGEGISNIAVSGSGVAIDSSLDALREQYTQLFGKAPHHNMGADKMRTAIDEKRKELGV

SEQ ID NO: 8052 - protein, 135 aa, Proteus mirabilis
YHDYSLITGTTLMQEDVYTKAGIGTTAFLGYFAGLPAEVVMGSLLGAIFFTTAATEYSFKRRSVLAFLSFVCGLIFFSPAATIFISVTGLFGVKPEQYEIEHIDAVGAFVSALLVVKLSVKAYGRADIPKQGGQQ

SEQ ID NO: 8053 - protein, 203 aa, Proteus mirabilis
YLCYKETGITMSEKSIVREAKDIRLAMELITLGARLQMLESETQLSRGRLIKLYKELRGSPPPKGMLPFSTDWFMTWEQNIHSSMFYNAYRFLLKSGGSVGVEAVVKAYRLYLEQCPPVKDQEPILALTRAWTLVRFVESGMLQLSVCTKCNGSFITHAHQPASNYVCSLCQPPSRAIKKRKLSANPADINLQLLDGLEQFAM

SEQ ID NO: 8054 - protein, 123 aa, Proteus mirabilis
MNSYNKYTDLQINELVATRLKKKCLLTEESVLAYMDSGYRTFDPCNNPTDAMPIIIENKISLLAGDGNFWCARYGEWNILPCPSGIEFIEKAQVINDSPYRAAMELFLMMKDAENEKIRPYLL

SEQ ID NO: 8055 - protein, 171 aa, Proteus mirabilis
RCSLLFRVLMLVVSDMKKHHVQIIPATHEHIVRLLPHVRQADVDEFYAMSMQTPEQVLRHGLSVSTKAYAGIINDEVVTIFGVASGSLLTGLGVPWLVGSNLLEQHQKTFLRRCKPILKQMLGQYSILMNYVDERNHIAKAWLHWLGFQIEEAKPAGLLQLPFHRFTLRAK

SEQ ID NO: 8056 - protein, 360 aa, Proteus mirabilis
TDPLRCTVYHVYSAIIIMSDNILSQAEIDALLNDDTSGDDAQKSANREPAIAKDPNEPDIQPYDPNTQRRVVRERLQSLEIINERFARQFRMGLFNMLRRSPDITVGGIKIHPYHDFARNLPVPTNLNLVHLKPLRGTALFTFEPNLVYIAVDNLFGGDGRFPIPVEGREFTNTEQRIINKMLKLALDAYRDAWDSIFKIQVEYVRSEMQVKFTNITSSPNDIVVTTPFQVEIGSMVGEFSICIPFAMIEPLRERLINPPIENLRQEDSVWLDSLVNQVKHSELELVANFTDIPLRLSKVLTLKKGDVLPIDKPERLIAHVDGVPVLTSQYGTVHGQYALRVEHLINPVLNALDEEQTNE

SEQ ID NO: 8057 - protein, 1330 aa, Proteus mirabilis
DARYEEHCMSSTTMGVRLDEETRNRLKDAAQKLDRTSHWLIKQAIFNYLEQIENDQLTLTPITQAEQDIEESTAPLTAHYQPFLEFAEQIHPQSVLRSAITSAYRIPETQAVPMLLQQATLPEHEAQATHKLAYSIAEKLRKQKQGVGRSGLVQGLLQEFSLSSQEGVALMCLAEALLRIPDKATRDALIRDKISHGNWRSHLGQSQSMFVNAATWGLLFTGKLVSTHNEEKLSNSLNRILTKSGEPLVRKGVDMAMRLMGEQFVTGETISQALANARKLEEKGFRYSYDMLGEAALTEKDAQDYLVSYQQAIHAIGKASNGRGIYEGPGISIKLSALHPRYSRAQYDRVMSELYPRLLSLTLQAKQYDIGINIDAEEADRLEISLDLLEKLCFEPELAGWNGIGFVIQAYQKRCPLVIDYIIDLARRSRRRLMIRLVKGAYWDSEIKRAQMDGLEDYPVYTRKVYTDVSYLACAKKLLASPNYIYPQFATHNAHTLSAIYHLAGQNYYPGQYEFQCLHGMGEPLYAQVVGKIADGKLGRPCRIYAPVGTHETLLAYLVRRLLENGANTSFVNRIADTTISLDELVADPVKEINKIAQAEGQIGLSHPKIPLPMQLYGDERKNSPGIDMSNEHRLASLSSALLTSAMEKIHSHPLIGGEYHSAEEVIAPQSILNPANHTDVVGTVRETTAAEANFALDIAQENGEIWFATPPAERAAFLVRTAELMEQQMGPLMGVLVREAGKTYSNAIAEVREAIDFLYYYSAQVANDFDNNTHRPLGPVVCISPWNFPLAIFSGQIAAALAAGNTVLAKPAEQTPLIAFKAVELFYQAGVPRSALQLLPGQGETIGAQLVADERVRGVMFTGSTEVAHILQKTLAGRLDSEGRPVPLIAETGGLNAMIVDSSALTEQVVTDVMASAYDSAGQRCSALRILCIQEEVADSTIEMLKGAMAQAIIGDPSLLSTDIGPVIDKEAKAGIEKHIQTMRTAGFDVYQATYNQLTKQAENNSTFVPPTLIELDKISSLKKEIFGPVLHVVRYSSQDLPALLAEINATGYGLTMGVHTRIDETIAYVATHAKVGNLYVNRNMVGAVVGVQPFGGEGLSGTGPKAGGPAYLYRLLSKRPENAITQTLARQDETLPLDASMRQKLLQTYHHYMTWLANKTEPAHYQALEEYANASQAGTLRVLPGPTGERNTYQLVPCGKVLCLSDNEQDIFTQLAGVFASGCHAIVHNAVFSQKTYRELPDMIRKAITLTDNWQDESLSINAVIYHGDSDQLKETCQQIAQRKGAIISVQGFSRGETALLLERLLHERALSVNTAAAGGNASLMTIS

SEQ ID NO: 8058 - protein, 266 aa, Proteus mirabilis
SVRYNALSIAGTDPSGGAGIQADLKTFSALGVYGTTVMTALVAQNTCGVHSVYDLSPDFVAAQLDAVLSDVRIDSAKIGMLSNASIIDVVCDKLQQYPIPFVVLDTVMLAKSGDPLLQPDAIDKMFTQLLPRVDLITPNLPEAAALLGCDIATDETTMKQQGEALLYQGCQAVLMKGGHLSEKESPDWLLTQDGQWRFTSPRINTKNTHGTGCTLSAALAAIRPQVSDWQSCVKQAKAYLQQALEQADSLEVGQGFGPVHHFHRWW

SEQ ID NO: 8059 - protein, 108 aa, Proteus mirabilis
AERYPMKLTNLKTSTETYENAKGEKETREEYPYGLRISLENDTIEKLGVSIPDVGESIELSAVAKILSKSINEREGKKSVYVELQITDLALGAGDTKSTADVLFDGGE

SEQ ID NO: 8060 - protein, 302 aa, Proteus mirabilis
LKGYRVLVLLGYIVVICAVLGGFTLVGGHLGALYQPAEFLIIFGAGIGAFVVGNNGRAIVSTVKILPKLLRNTNYNKAMYMDLMALMFRLLSKARQNGMLALERDIENPQQSDIFSQYPRIMKDVYMLSFITDYMRLMVTGNMNPYEIEALMDEEIATFEEESEVPAAGLSTMGDSLPAFGIVAAVMGVVNALGAADRPAGEMGALIGHAMVGTFLGILLAYGFVSPLASRIRQRSSQQMKMMECIKTTLLSSMNGYAPQIAVEFGRKTLFLADRPSFIELEEHVRQVRTPMQANPDAMKEE

SEQ ID NO: 8061 - protein, 134 aa, Proteus mirabilis
DIMYQQSASKMYAQIDVESEILNASPYQLIQILFNGALSALRRALILMEQGNIAGKGENISKAINIIGNGLKQGLDKEKGEELAENLALLYDYMITQLLDANLKNNPEKIHEVIKLLTEISDAWQQIGTQINSY

SEQ ID NO: 8062 - protein, 141 aa, Proteus mirabilis
GLSYMKFMQDLVVDILRDNKKSLSVNEITAIASDLKGKKNRSTTNYALIKLIESSVVERKAVVGIGYVYKLTPDYMERLRELDIKKEASLMTKKPAKPTDKHVICQKGSLTYVRKSLPPLQHGKIADIHNRMNAMLVAVRA

SEQ ID NO: 8063 - protein, 223 aa, Proteus mirabilis
SRDFFVWLRRTLGEIMKIVEVKHPLIQHKLGLMRDHDISTKRFRELASEVSSLLTYEATADLETETVTIEGWCGPVEIEQIKGKKITVVPILRAGLGMMDGVLENIPSARISVVGVYRDEETLKPVPYFQKLASHIEERMALVVDPMLATGGSMIATIDLLKNSGCTSIKVLVLVAAPEGIKALEEAHPDVELYTASIDKHLNEHGYIVPGLGDAGDKIFGTK

SEQ ID NO: 8064 - protein, 122 aa, Proteus mirabilis
MNKYSNRKSIVDKKVTKRAMELLLKLFPDYYSQDDLYSDDECCEWHYCKTDYYGEFDAYDAFYELHKSLIVQTTDWNGVNATEENNEDKTPYYSPWRLSGKIGRREVISHCHKLVKAGVVWG

SEQ ID NO: 8065 - protein, 255 aa, Proteus mirabilis
INNLFERGKKMKILFIGESWHIHMIHSKGYDSFTSSKYEEGATFLLNCLREKGVAVDYMPAHTVQVAFPQTDEELAKYDVIVISDIGANTFLLQNDTFYNMKVLPNALGLIKQFVANGGGLLMIGGYLSFMGIEAKANYKNTLLAQVLPVEMLEGDDRVEAPEGVFATPVNAEHATIKGFSEWPMFLGYNKVFAKHNTETVLNIGEDPLLVFGQFEKGKTACFMSDCSPHWGSKEFLAWPHYADMWVNILKQIAR

SEQ ID NO: 8066 - protein, 66 aa, Proteus mirabilis
QFFHCIHHYSYLIAMEKLRQKVLFFLLCYYQRALLAIGDVRQYLGSLLMWLFSVDGQQLVPNHKYR

SEQ ID NO: 8067 - protein, 329 aa, Proteus mirabilis
SIIQKEHLMSTKNLSTPLLMVATVLAGMLSPMQSAVNGQLGHVLKDGNASAVISFASGLVVMFFIIMSKKQYRQQFASIPTLIKTRKIPLWNWFAGLCGAMVVFSEGASASALGIATFQTALISALLLSGLLCDRFGIGVDEKKYFTPYRVLGAVLAVVATLFVVSPQWHSTSFIYLAILPFLAGLLAGWQPAGNSKVAEATGSMMVSITWNFIVGFTVLTIALVVRMALGHITLELPATWWMYLGGPLGLMSIALMAILVRGLGLLMLGVASTAGQLLGSVLIDLLLPSLGNTVYLVTIIGTLFALVGAIVTTIPEFKATKSVKRAGA

SEQ ID NO: 8068 - protein, 264 aa, Proteus mirabilis
AARLAFLILILSLIEFVLESRRLLNYSGEVLLNTPSQLSLPLSLPDDETFDSFYAGENASLVAAIQTAIHQSHGSYIYFWSRDGGGKSHLLHAACAELSLAGDAVGYVPLDKRAYFVPDVLEGMEHLSLVCIDNVQCIAGDEEWELALFNLYNRVLELGRTCLLITGDRPPRQIDLQLPDLASRLDWGQIYRLQPLSDEEKIQALQLRAKLRGFELPEDVGRFVLKRLDRKMRTLFEMLDELDHASIVAQRKLTIPFVKDILKL

SEQ ID NO: 8069 - protein, 304 aa, Proteus mirabilis
IYSLMYSGWIMIFSRYSLFLLVTLGLLSGCVQQPQLIDRGDYFAQVVPNNPGQDNRVKFLVMHYTAVDDKESLKTLTSGNVSSHYLIPTKPNYVDGKPVVFALVSEDKRAWHAGLSQWGNSAGLNDGSIGIEIVNYGYNDQGTLREWLPYTAEQLSTITMMMKDIIQRYGIEPQNVVGHSDIAPQRKVDPGPLFPWAELAKQGIGAWPDDETVTFYLAGRAASEPVDIANFQTLLAKYGYQTPTTGILDPETQKVVSAFQMHFRPSDIKGIPDAQSEAILMALIDKYRTKWIQPSTEPIKHSDN

SEQ ID NO: 8070 - protein, 159 aa, Proteus mirabilis
QMSQIPCFAYAMLNRNSSCFKGYFREVIMKLSKLVGQTGILGAGFFLAVSFGASAESVTNVNNDNNVVRSAPFASCVNLDKEQLATRVKNDYLLNRLPRWQDDKKALGPKPVANINANDVIKRDNSYHVILDVRGARTDLRYNVEVNCDENKITYISSK

SEQ ID NO: 8071 - protein, 160 aa, Proteus mirabilis
PLGLNWNLKACRRFILSIILWSMKNETNIRRGRHCVFLMHVHLVFVTKYRRKIFDQDAIEKLRGYFASVCADFNVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 8072 - protein, 149 aa, Proteus mirabilis
SMEQIPSFSSQGAVNTAAPATTQTIQTPAQPLPVGQSLVQVSTALAGIIVLIIVAMWLFRRFGFARGTFKANQAQLTVKANCSLGTKERVVVVEIEQEWLVLGVTASQINLLHTLPIPNHASQEAPIPPSSPLFIQLLQKTLKRDKGNS

SEQ ID NO: 8073 - protein, 551 aa, Proteus mirabilis
KDRQMSNNLINTAMSGLNAAQAAMSTISNNIANQKVNWYNRQMTVFNENGGTMTSNGYIGNGVNVSRIHREYNEFLAGQMNRAVTKQSALNSYNKNISQINDLLADKGNDVSSAIDDFFTSLPNVTNNAEDNPARTTILGKAEAMVNMFNKADQSLRDLEKDINSQVTNTTKNINEYSKQIAKLNQEISRSQGFNGAEPNDLLDQRDRLIQELNTLVDVQVTQQDGGFVNVSFANGLPLVAGTRSYEVSAIPSSKNSERLVVGYSNGIDEVREVDAKRINGGELGGAYRSRNEVLDASRNQLNQLALVLGDQFNKQHEQGFDLNGDKGDKFFNLGGAHTMPNGKNKGDATFDVKYTDTREVKAADYTVKYEGGKWNVTVEPGNRKFTATPNATTGELEFEGMSIKVNGAAQEGDSIVVQSVGNVIAGMSVAISDPSKIAAAGTKDSGPSDNENMKKLFELPDEKLIDGKATIAGGYGSLISMVGNKVNTAQVDYDAQNAITSSILTQQQSVSGVNLDEEYGEMYRIQEYYMANAKVIQTANTMFDAIMQVL

SEQ ID NO: 8074 - protein, 184 aa, Proteus mirabilis
NAMQLNIPTWLTLFRVALIPFFVLVFYLPFKDAPLICAIIFMVAAATDWFDGFLARRWKQTTRFGAFLDPVADKVMVATALVLITEHYHVWWITLPAATMIAREIIISSLREWMAELGKRNSVAVSWIGKVKTTAQMGALVVLLWRPTIEAEWFGFVLLYIATVLTFWSMFQYLSAAWSDLREA

SEQ ID NO: 8075 - protein, 273 aa, Proteus mirabilis
LLVHHNNSRFLVTVLSKTIWKIIVSKKKIVISLAIIAGLSTPTAFAGEWSIGGSVLSQVTPYKGAKSKDYLLPVPLVNYQSENFYFATLAAGYYLWNSPKDQLSVDVHYYPQAFKPSDSDDEQMKKLNRRRDTVMGGFTYKHHESWGSLRGIISGDLLGKSNGIIADAAYLYPFELGNWSLQPGIGAVWENKKQNRYAYGISQGESQRSGLAEYRPNDSWRPYVEISANYKFAENWDFFAMGRVDRLPSEVKDSPMVNKSVTAILWTGVTYTF

SEQ ID NO: 8076 - protein, 129 aa, Proteus mirabilis
FGKHNMKRILLIIAGWLCVGLATLGVVLPVLPTTPFLLLAAWCFSRSSTRFHHWLLYRSWFGGYLRYWQTYRAMPKGAKPKAILVILVTFAISLWLVSMWWVRILLLIILACLLIFMWRLPVIDKQDVS

SEQ ID NO: 8077 - protein, 98 aa, Proteus mirabilis
YMEQSMEVNDLISMVTPEIYQRLSTAVELGKWPDGVALTAEQKEHCMQIVLLWQAQNNHNPEHMTVGTNGQITMKSKQELKAQFQAERLATLIPMDDD

SEQ ID NO: 8078 - protein, 166 aa, Proteus mirabilis
GAIKMTHSDLCEIAVRFLQNNGFNVAFGDRFQSRNGTGEQPDAIGFRSGISCLIEAKVSRSDFLADKKKWFRQQPEKGMGDWRFFLSPPDIISSEDLPAGWGLLHVKGKRVFKVHGWPPNTYWYDKKPFKANKQAECDHMYSALRRLQIRGHLHEIYEGIPKGVIS

SEQ ID NO: 8079 - protein, 83 aa, Proteus mirabilis
LKINLIHCNKRIYLSLELLLVVLVIFFFTRNNNWCNIANRQFYFLIVLIRYLILIFIPYLEFIFYFLLLKRLRILFFRERGYA

SEQ ID NO: 8080 - protein, 79 aa, Proteus mirabilis
QSVKPSVLFLTLFLRPPLTYLSIKGGFFISGIKNKKEQHNVTPFFRSLLNAISDHYSSRLALGTNQDIAHTYVGQCCSY

SEQ ID NO: 8081 - protein, 148 aa, Proteus mirabilis
IMAKTILVAIDLLEDDRIHRMVKDIQFLARKADHYFHFVTVMPNLRSLEAYGLDCDSPSVIEKKHQAVILLTEKLAHCVQQQFQLPKEQYQCHALIGTPNYNILELANKMDVDTIVIGSSSRNRHNILLGSTADYIVNNTNCSVLVIR

SEQ ID NO: 8082 - protein, 118 aa, Proteus mirabilis
LPYNKLTIDSLIQRKNMIIAYSTAPNETVAHEIAHHLIQAKLAACINVLPNIKSIYHWNNEIVEDNEVLMMIKSESSKQQILIDTLVKIHPYDTPEVIIIPIENGFHGYLEWIHQSLN

SEQ ID NO: 8083 - protein, 340 aa, Proteus mirabilis
FTNKAGGIHMTIKVGINGFGRIGRIVFRAAQERSDIEIVGINDLLDAEYMAYMLKYDSTHGRFNGTVEVKDGHLVVNGKTIRVTSERDPANLKWNEIGVDVVAEATGLFLTDETARKHIQAGAKKVVLTGPSKDSTPMFVMGVNHKSYAGQDIVSNASCTTNCLAPLAKVINDKFGIVEGLMTTVHATTATQRTVDGPSMKDWRGGRGASQNIIPSSTGAAKAVGKVIPELNGKLTGMSFRVPTPNVSVVDLTARLEKPATYAQICEAIKEAAEGELKGVLGYTEDAVVSTDFNGEVLTSVFDAKAGIALNDNFVKLVSWYDNEVGYSNKVLDLISHISK

SEQ ID NO: 8084 - protein, 140 aa, Proteus mirabilis
NKNNSYNIKGTLMKKVLPIAIVLMGSLSFGAIANNSHMNMNMSTNVAQSNSPMNQELMDSMNKMHENMAKGMNSANADVAFAQGMIAHHLGAIDMAKIELKYGTDPEMRKLAQAIIDAQGPEIEQMQKWLEKNNTNMQNN

SEQ ID NO: 8085 - protein, 622 aa, Proteus mirabilis
CGDNMSKIMELIGTIFRFSWQAINFIRKLILNVIFFFLLFMGVGLYFIVQETQKPTDYQGALLVDLKGVIVDQTANQNPLGQMSRELLGVSGSQLQENSLFEVVDTLRKAATDPKIKGMVLKLDEFAGADQPSLNYVGKALTEFKKTGKPIYAISGYYSQPQYYLASYADKIYLASQGAVGIYGLGFSNLYYKSLLEKLKVNTHIFRVGTYKSAVEPLMRDNMSDEARAASNRLVSVLWSNYLTQVAENRSITKEDVFPGAKEMIVELRKADGDNATYALNRKLVDTVSSYAQFEADMKETFQWDHEAKQFNNISIYDYADNLTAFAPENEDGNIAVVVVQGAIIDGESIPGSAGGSTIANQIRQARLNPNIRALVLRVNSPGGSVSASEQIRSEIAAFKQEKKHVVVSMGGMAASGGYWISTPASKIIASPSTLTGSIGIFGVINTFENSLESIGVHSDGVSTSPLAGLSVTNKLPEDFSELFQLNIESGYKTFLKLVAESRNKTPAQVDRIAQGRVWVGVDAKQVGLVDEFGDFDDAINAAATMAKIKQPVIDWMKPELSLSEQILMSLSANAKAIIPDPLQSYLPALVFKEVKTQTEFYRNMNDPQNRYAYCLSCGDIQ

SEQ ID NO: 8086 - protein, 122 aa, Proteus mirabilis
IRDNMTNKVTIYHNPRCSKSRETLHLLEEMHITPDVIHYLDTPPSVDELKALLKALDFDDARKLMRTKEEIYKTLKLADESSQEALIQAMNNHPKLIERPIVVVGNKARLGRPPEQVTALFK

SEQ ID NO: 8087 - protein, 125 aa, Proteus mirabilis
RQCNQVYKGVNMSLVDKQNTFTGMVAKLITFAQQKGYKLTFGETYRTEEQAKLNAKKGSGISNSLHTQRLAVDFNLFDTNGKYLTATSDYKELGEYWESLGGSWGGRFKTRPDGNHFSLEHNGVR

SEQ ID NO: 8088 - protein, 120 aa, Proteus mirabilis
IKCKREVGMNSVIQKRTSQQLSVERVAVLERMTVLTKELVNELAEKKSLASALKMSDNELAQLIFETQLIRSSAISPREQRKIARLNEGAIKFSERLKELGGTCRASQVAAIFGSKTSND

SEQ ID NO: 8089 - protein, 391 aa, Proteus mirabilis
FFSKTYKEFLIMTVLTVYLCGTGASSFDNNNHNNPVYWQGELVSTLAHNNLDREFAQWFIVDGPGSGNLQEDDLWVESPNYSDIKGSLFGSGWEENVEHALCLMKGNFDWQREKLTEQQYNQLKKAGIPIEDVEVTGSFLWRKYNYGDRYVTQQQLQQQIIRTFRKDGIIPTQVNLMGWSRGGITCHMLANAMLKDPLLKDIPVNIFAIDPVPGPLNFQPEKVTLGSNVKEYVGFYAIDERSKGFACVIPTVTAETKMHIFPLSGRHATLVGNAAIDGSEGKNALFSPGLIVRHFAERCLTRWGCQLANKLELTDKEIFEHHTDIKNDADKYIAMRRKTYSIYESSGDDERKVSLGKEGKAFSDIYGAQYEPSMALTADYFADPQLYDVIK

SEQ ID NO: 8090 - protein, 65 aa, Proteus mirabilis
DKSNIMFLGMPTLTHEEQQKAVEKIQHLMSEGMSSGEAIQLVAQELREKHTTRESVSIVFDDDND

SEQ ID NO: 8091 - protein, 112 aa, Proteus mirabilis
LLPNAIIYGLFTPPSQLGVVPRAGLEPAQPKGRGILNPLCLPISPPGHLWRRVPESNRGTRICNPLHDHSANAPQLLNLLRDWSGKRDSNSRPQPWQGCALPTELFPLYRTC

SEQ ID NO: 8092 - protein, 148 aa, Proteus mirabilis
NSPKAPDGIVHNGFLELFFRRRGYYARRNENQGLNTAPTLGCSAGIGVLCGLGLYPLATVATLLIFCANILLREAAQRINAQPQYQATDIEQRYSIRIVCDTHDEVLVRTLILQAINGLHVRLQSLSSADTPMPSQLEVCAEVLGYPS

SEQ ID NO: 8093 - protein, 226 aa, Proteus mirabilis
MVNKKNLHKELAQLEAEGHIPYKIQEENQQKRWQWKHYTSGVHYFAPTDPLEMGRYNDPTGITGICYTADYAVVAIAESLGRHYQHNKAFILGLSDLKKAQIYTLATTRKTKLIDIPKLQGILHITADQVMGKSYDITQNIVDWAANTPGLDYDGIAYSSRHYYGMCTAFWCRKHIIPPLVDISHCSLDLYTDCKKENFPQNWPYQDITGLEIITETLHFKINDNE

SEQ ID NO: 8094 - protein, 414 aa, Proteus mirabilis
VCNKAFKRVTTLVMEKLVDIYDFIVSKQIFTTLFLVITLLVVWFLAKMIFRRIAKRLLFLFTELSDEETIEDIAKKSASIVAVTLVLYINQLLPSFSAQMNIIFETVCRAFIVINIASLLNNALDIFNIRHAKKSWHRNNSIKGYIEIAKIVVWIIAFILIIALFTEQSPLIIISSFGAIAAVLMFVFQHTLISFVANILISNGKVLKLYDWIELPSSNISGEVIDIALHTITVRNWDNTISRIPTKDFLTEKYTNWQPMFSSGGRRIKRSFYIDQSSISFATEQLVQELKNTAPLKKSIEAMLEGKEEEIGDINTWLETNGVTNLQLFRKYMLNWIKMRGDVRPDMYLVIRTMPPTPMGLPVELYCFTRATTWVEYEETQSEIFEYINACAKYFKLDIYQQPSGHDLSKITFK

SEQ ID NO: 8095 - protein, 427 aa, Proteus mirabilis
SVLKPKEMSMKKNALFTVSLLSVFISLSCYAHQDVILHSDSLSDAKVSINDDTGKTQIEVINTNQDGTAHIYYNRLDVGNFGLSLKNNAEAELIINEVVSKDVSILRGELELQGKKATVVIANPNGISCRDCSFSGINDIKLIVGSSTGKFSKTFTIADIGSSVVFDMRNKLDKNEYSHIHRNYKDISSGMINIISNNVDLIDGDLNAEYIRFDIGLSEFNLGAKNDYNKYSHFLLRTEAGINSRYLIIKAKQGNVYNDGNINTLSLNHESYSLINAGNIDINQDDNLYRTAYDGTKQSKVMVYKYSSVLNNSSFNVKDSILFMKADTLLLDRTFNIDDSYLYGRVGTIGIGNISLSYNSVFHIVAEDSIFLGGKIQGDGHVILQLNDDKVDIEGKNLLIGTEGLRLEGGTKYKLGRSTIIDYTEYK

SEQ ID NO: 8096 - protein, 760 aa, Proteus mirabilis
AYLNKTKNRFIMKTQLTRNILGSCILFSGIHSLVFAAETEKTVQFSSLKVSSAQKQTPEQKALSKPGAYSAIGEINNLSSVEQALRSTPGTYTQMDASQPGVGVNIRGLSGFGRVNMMIDGVTQTMYSTSPSQYAHGGQPYNQFNSMIDPNFIVQIDISRGQQDGENSINALAGSANFKTIGIDDVLFSNHRWGIRSKAARGTNGLGYNGMVAIAGKQPIFNHDGYIGAMFAISGHNIESSYKNGAGFNSHEFATTKDFNQKPHSELAKISFKPNDSHEIELSGRFYNNKFNRRTIESQDYYAKYRYTPLNDLFDSEILLSRSQASQKFAGDSLMSLRNGHAKNISNALVAKNTSRFNYHELDMALTLGTKLMSIDYNREVTAPSSDPWQSQNMIEYNVFAPQGKNDISSLFSQMKFEYDIYTLALNLNYTDYHIKGYKPACDPKAACFPEGAMNVNRHEKAWEPGALFSAQIIPEFEPFISYAHTTRAPNPQEIFFANEGGASMNPFLRSEKADTFQIGFNSYRPDLIVAGDSFRLKALWYHTKVKNYISSDSYNVCKGGKRCKIDGTFTDDDYSGMEYDGNIYLYTNSLDPVTMRGYELQVNYDADVFYTTLSYSNERTSQPTSLAMGDFGQSPASELPKYYATIDAGVRLFDDRSLELGTIIQITGKSRKASAEGFDFDTGTIPMVEQEKIPTVINAYANYQMNKNVSLKFAVHNLMNKNYSNALDRSNSAPIMDEQGQNKQTARGRSFLFGGEIRF

SEQ ID NO: 8097 - protein, 151 aa, Proteus mirabilis
IILKIMMEELRQTLDLQLSQLNTIAGILRAEQQLLCAGSIDINKLHEITEQKNFVLTALGHTDQKRQILSKQVGIDRPYQGQPFLADLWGQLVDLTEELKHLNQHNGLLSEQHITRNSETLHFLQKNHSPTLYGADGQAQRSILAGRKIQI

SEQ ID NO: 8098 - protein, 106 aa, Proteus mirabilis
CLTKDFPMSIERTNPLIPITAISQRNLNEGAQEARKTGNTQTKAMAGDTSVKLSEAQKKLVQPSNQDINVEKVARLKAAIADGTLTMDSSKIAEALFREAAESITK

SEQ ID NO: 8099 - protein, 66 aa, Proteus mirabilis
CLQNYIAIVILARGSHCLPPCFIAIYYASFPAGSGLNTYFFLHLCQNLLLSILFSLFKHYFYKIIT

SEQ ID NO: 8100 - protein, 352 aa, Proteus mirabilis
ISKKSRGIIMKGYIQTVTGPVKKADMGLTLPHEHLFNDLSGVVDEPFYEFSHVLVDKKVSADIQWGLKYDPYCCCDNMDKKPIEDVIFELNNFKELGGKTIVDATGSSSIGRDIRKLKQVAELTGINVVASSGLYIEKFEGKRLADDIDAMAKMIDDELNIGIDGTDIRAGMIGEIGVSPFFTDGEKNSLRAAALAQNNNPYASMNIHMPGWQRRGDEVLDILLTEMGCDPAKISLAHSDPSGKDIDYQCKMLDRGVWLEFDMIGLDISFPKEGAAPSVMDTVEAVATLIERGYGNQIVLSHDVFLKQMWAKNGGNGWGFVPNVFLSLLAQRGIDKAIIDRLCIDNPANLLA

SEQ ID NO: 8101 - protein, 386 aa, Proteus mirabilis
FGKKHRSLMMLHKKLHSEMSWEQLGEYYDEISDMSGVRQDPIHHAEGDVAIHTQQVIHAIKSLPEYQELSEREQQILWIAALLHDVEKRSTTREENGRIISPGHARKGELTTRRFLYEKVPVSFIDREQIAALVRYHGLPLWLMDKPDPKKALLAASLRVDCYLLALLAKADVLGRSCEDKPSLLDKIALFTLYCEELNCWRTPARFISDGARFHYFHSENSVDPHYEPYPEQGSEVIVLCGLPGMGKDSYIRQYCADMPVVSLDALRQQHNIKPDDRDANGWIAQLAKEQARIYLREHKPFVWNATNITKQMRNQLIALFYRYQAKVTLVYIEVPYLQWKKQNSARKEAVPDKVMERMLSKLEVPTPEEALNVIYWVDGEAQNLI

SEQ ID NO: 8102 - protein, 200 aa, Proteus mirabilis
TQRNRSFAYFCFYLLRLQHRALSLMSVSTQKKRPLSRYIKDYKHSQTHCLHCHKALDRISLVFNRQVINKEAISEMTDLIDDETWETLQGKFSALCRFCSEIYCNSETDYFDIMSFKQYLFEQTEMSHSTVREYVVRLRRLDELLTSTNFPRQEFTTEKIQSDLSKKLTPSAFSNYNIALRKYEQYLDWCQAPTSMSSGH

SEQ ID NO: 8103 - protein, 331 aa, Proteus mirabilis
QRGNNMPALTLVDWAKRQGPDSKQAKIVELLNQSNEILDDMVFVEGNLPTGHRTTVRTGLPSATWRLLNYGVPPSKSTTAQVTDAIGMLETYSEVDKDLANLNGQKNEFLLSESIAFLESMNQQMAETVIYGDATVHPQRFTGLAARFNDMKAKNAVNIIDAGGTGSNLTSVWLVVWGENTVHGIFPKGSKAGLEQNHLGEVTLEDENKGKYQGFRTHFQWKNGISVRDWRYVVRIANIDLSKIGKDPEKADTLDLPDLFIQAIEKIPNLSMGRPVFYCNQQIRSWMRRQIKNSKNVNISMAEVAGKKVVSFDEIPVRRVDAILTTEDQVK

SEQ ID NO: 8104 - protein, 79 aa, Proteus mirabilis; identical to SEQ ID NO: 4611

SEQ ID NO: 8105 - protein, 410 aa, Proteus mirabilis
TIMNITTPNSVNEVSRKTAWIRVIILSFAAFVFNTTEFVPVALLSNISESFAMVPAQTGLMITIYAWVVALMSLPLMIMTSKVERRKLLIILFIVFILSHVLSGVAWDFNSLIVGRVGVAFAHAVFWSITASLAIRMAPHGKKAQALSLLATGVALATVLGLPLGRVVGQWLGWRATFLGIGVLALITMLALMRYLPLLPSEHSGSLKSVPILLKRAPLVGIFLLTVIAVTAHFTAYSYIEPFVIDIAKLDENFATIVLLIFGGAGILGSVLFSRYSTKMPTSFLFFALILLTVCLSTLMMSSQHTLTFIALIIFWGIGFMCIALGLQVKVIDLAPDATDIAMSIYSGIFNIGIGAGALLGNQVILHAGMPNIGYAGTALSIIALAWCGFIFTRYRVAMGGKPREKNRLH

SEQ ID NO: 8106 - protein, 100 aa, Proteus mirabilis
MNMNKPIRNAEKDKSDAQMNSRIGLYIFFAGIVLLISKYIWGTDVSSALAGGIAGGGLVYWGMNYDKVSKLKRKLDELCYKKYNKPHKDSWNDIADDEGY

SEQ ID NO: 8107 - protein, 298 aa, Proteus mirabilis
KIMKRNVTEELPDIAAQPLDFFSERFMLSDDQFQSICQLIYQKAGIVLTNNKREMVYNRLTRRLRELRMNNFGDYLAFLKSDVCNPEWQEFINALTTNLTAFFREAHHFPILAKHAKNRAGGVYRVWCAAASTGEEPYSIAMTLRDVFGDNPYKTKIIASDIDTNVLEKARKGVYRLEELKTLNEEYLKKYFLKGVGDFAGYVKIRPQVSEMVTFQYLNLLDKQWKLEGPFDAIFCRNVMIYFDKTTQQSLLHRFIPLLKPDGMLFVGHSENVSQLSKDFYLQGHTVYGLTPARRGYE

SEQ ID NO: 8108 - protein, 475 aa, Proteus mirabilis
MIQNTCLNGHKIDMQLQQRELTYTPDLALRVFAPIASLSWSSLLHSGFAEHHHNRFDIVVSDPAITLETRKQITTIKEKTGRVKRSKKDPFTLIQTALDAFNFHPVSDERLPFLGGALGIWSYDLGRRIEILPELAKNELNFADMAIGIYDWALIVDHQLKKATLISYQDIDARLQWLTKHADNNTIEKKEPFVLTSPWQSNMSSDEYNEKIAKIHQYLLSGDCYQVNLAQRFCANYSGDEWNAFLTLNQANKAPFSAFMHLPHHFVMSISPERFIHLSDHKIETRPIKGTLPRKAHPDEDDEQAQLLANSRKDRAENLMIVDLMRNDIGKVATTGSVKVPELFVVERFPAVHHLVSTITAELPENLNATDLLRAAFPGGSITGAPKIRAMEIIEELEPHRRHGYCGAIGYISFCGTMDTNISIRTLLTEKNKIYCWAGGGIVADSVAEQEYQETFDKLGQILTVLSEVSPDDTY

SEQ ID NO: 8109 - protein, 553 aa, Proteus mirabilis
LFEKGLKTENVNKPFNLMTFYLFWNSPQMTANIHNHRILILDFGSQYTQLIARRIREIGVYCELWAWDVTEEQIREFNPNGIILSGGPESTTEDNSPRAPEYVFNAGVPVLGICYGMQTMSMQLGGDVEVSGEREFGYSQVEIRETCELFRDIQDSVSEDGKPLLDVWMSHGDKVTAIPADFVTIASTETCPFAIMANEEKRFYGVQFHPEVTHTHQGLAILKRFVLDICGCDALWTSAAIIEDTVARLKQQIGDDHVILALSGGVDSSVTALLLNRAIGKRLTCVFVDNGLLRLNEAEQVMAMFKGKFDLNIIHVEAEDRFLTALKGENDPEKKRKIIGHTFIEIFDEEAIKLPQVKWLAQGTIYPDVIESAASATGKAHVIKSHHNVGGLPEDMKLGLVEPLKELFKDEVRKIGLELGLPYDMLYRHPFPGPGLGVRVLGEIKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 8110 - protein, 265 aa, Proteus mirabilis
CKGKTMIRSLWIAKTGLDAQQTNMDVISNNLANVSTNGFKRQRAVFEDLLYQTIRQPGAMTSEQTNAPSGLQIGTGVRPVATERLHSQGNLAQTNGTRDVAIKGQGFFHVQLPDGTDAYTRDGSFQMDQNGQLVTSSGFQIVPAIILPETAKKVMVGRDGIVSVEIEGSPAPQQVGQLTLTTFINDSGLESVGENLYLETASSGAPTENAPGINGAGLLYQGYVETSNVNVAEELVNMIQTQRAYEINSKAISTSDQMLQKLTQL

SEQ ID NO: 8111 - protein, 211 aa, Proteus mirabilis
CASDLGRNQILCLPVRNKLKVKRKPILPIPDKHFLVLTALGTDRPGIVDTITQLVSQCGCNIEDSRLAMFGQEFTFIMLLSGGWNAIAQLEALLPIKSAELDLLTVMKRTKMGAPVSYPSTITAKVDIEDAPGIVERFTNLFSQHHFNLAELVSKTHPSEDGTPARLEIQITAHNPLDDHGLVIHEKFNQLCTELNAQGTISIVNSLMMKQ

SEQ ID NO: 8112 - protein, 350 aa, Proteus mirabilis
VMTDIVSLLGADANSLLEHRCQTIPSENLYLPGSDFVDRVMIDNNRPNTVLRSMQTLFNHGRLAGTGYLSILPVDQGVEHSAAASFAANPLYFDPKNIVELAIEAGCNCVASTYGVLASVSRRYAHKIPFLVKLNHNETLSYPTQYDQTLYASVEQAFEMGAVAVGATIYFGSPESRRQIEEISMAFERAHELGMVTVLWAYLRNPAFKKDGVDYHASADLTGQANHLASTIGADIVKQKMAENNGGFKAIGFGHTDERVYTKLTSENPIDLVRYQLANCYMGRAGLINSGGASGNNDLADAVRTAVINKRAGGMGLILGRKAFKKSMKDGVALINAVQDVYLDKSVTIA

SEQ ID NO: 8113 - protein, 164 aa, Proteus mirabilis
SRADENQHNTIIAYLIKFSLNSNTVICQYILKEFSMASKDLRFLVVDDFSTMRRIVRNLLKELGFMNVEEAEDGADALAKLQSSAYDFVITDWNMPNMDGLELLKNIRSDAGLATLPVLMVTAEAKKENIIAAAQSGASGYVVKPFTAAILEEKLNKIFEKLGI

SEQ ID NO: 8114 - protein, 234 aa, Proteus mirabilis
RNNDMKKVLLSLAMLSVISTPVLAKTPVANLKINGDIKPPTCTVHGATQSDVIFDYGVISPTLIPQSKNYEYPLATGKNTVTVECDAKTYLTFVASDTYDSAELANDTTGQFHLVDKANPETAVGAAFFIWTNITVDGKPAYISRANDVAITGNKFNNVLYKGPTNGWTSEQQSDINKNSLSLISGEIFQANFSQGKTSRTFILSKDALSKKGIDIADGLDFVGEVVLTFNFGV

SEQ ID NO: 8115 - protein, 182 aa, Proteus mirabilis
IMCEPTTLAAAVIGTSALQAYGQYTDGKFQASVANQNAKINEGAALDAINKGNAQAQEQRRRTRQLAGTQAATMSASGIDLSTAGALDILGDTAAMGELDALTMVNNASREAYGYRMQAENDRLNAKMARRSGNMGAMTTLLTAPIQAYGAYQLAGGTWSPFGGGSGAVKAGKTFAKAPKGF

SEQ ID NO: 8116 - protein, 138 aa, Proteus mirabilis
KMLDKLENTFHFQQEALSLRNKRQEILAANIANADTPGFQARDIDFAAELKKTMENGRTGSHGLQLTMTSERHIPIKPGYRLEADLLYRVPHQTSMDGNTVDMDMERSNFADNSVKYQADVTFINSQVKSMMAVLQQG

SEQ ID NO: 8117 - protein, 74 aa, Proteus mirabilis
RCVDMCNPFGNTPKITTPPAVQAAPQEQDAAVTGSRDDEMRRRRAAAGRKSTLLTGAQGATSSASTSGKTLLGQ

SEQ ID NO: 8118 - protein, 91 aa, Proteus mirabilis
MGPEAKGAKNARLCTHVLVADGYSGLFLGSIETHPKPQTELFTMGFWNCFLGAGVIMPEGMKIRVLIPRRHLVALRALVCYVDLDSIHLLP

SEQ ID NO: 8119 - protein, 315 aa, Proteus mirabilis
IVRLSSNQIYTQRVDNITSSQSRWMTEGNKISSGRRVEKPSDDPMAASQAVMVKQSEARNQQYATARGFAKNSMSLQMSLSSQMVNITTKIQETLVAAGNDGALSDEDRASLAEQLSGLKDQLVGIGNTKDGVGRYVFAGFQTDKPPFVADKTGKITYQGGDKQITQKVDSNIEMVSNFTGIETLQSSGGKGTEPDIFNALDEAISALREPLVGKPQADRDAALDKINTANRVNRATLNNISSVEAKLGLQLQELDNLDDLGADTSLRNAKRLSELRDLDWTQAISDYYQEESVLQASYKVFNDMKEMSMFKMYR

SEQ ID NO: 8120 - protein, 452 aa, Proteus mirabilis
KCIDIGKLTENIANIWATKTNQSSKYQMIARLIGNLMNIVHRLKLVSFLQFFIWGSWLVTFASYLFDKLHFKGTDVGLIFSALGLASLIAPVIMGFIADKINNRKLVFIILHILSAFALVLMSQMTTVTTLFFATLLHLLFFMPSISMANSIIFELLEQKHLEPNDYFPKIRVYGTVGFIAAMWVISFLGFGNSYDQLFVAAIASIILAVFAMFLPATKATDKTEAKEEVAAFSLSNTLQVFKKKNVVIFLFFATLLGSVLQITNTFGVPFLQDMAKAPNADDSFLAHYPSVFLSISQISEVVFILFLPLLLKRVRIETIVLFSMIAWILRFGFFAYGDYSSLGQIVLLLSMIVYGCAFDFFNISGSLFLEKEIPLQYRSTAQGMFMTLVNGFGTYLGAMLSGWVIDLYTTDGVIDWQSFWLIFTGYTVAITALYLIYLVVPQKKTKVVEAH

SEQ ID NO: 8121 - protein, 495 aa, Proteus mirabilis
VMSEALQKSPEEQLIEDIASFTHDPLGYAYYAFPWGEAGGELEEYNGPRQWQAEALNEIGEHLRNPKTRHQPLLLARASGHGIGKSAFISMIIKWGMDTCEDCKVVVTANTENQLRTKTWPEIAKWQRLSLTNNWFTCTKTAIYSNDPNHANAWRADAVPWSENNTEAFAGLHNKGKRIILVFDEASNIADLVWEVAEGALTDEGTEIIWIAFGNPTRNTGRFRECFRKFKHRWNTKQIDSRTVEGSNKEQIKNWEEDYGEDSDFFKVRVRGVFPSASELQFIPTGLTDEAMKRIVTQAEVAHAPVIIGVDPAYSGIDDAVIYLRQGLFSKCLWTGFKTTDDVVMAKRIADFEDQYKADAVHIDFGYGTGIHSIGTSWGRVWRLVKFGGASTDPQMLNKRGEMYNSVKTWLKIGGAIDDQETADDLSCGEYKVRVIDSKIVLEDKTEIKKRLGRSPGKGDALALTFAYPVTKIDRNYTSPHSGVNVSNSDYDPFA

SEQ ID NO: 8122 - protein, 153 aa, Proteus mirabilis
LYTDTKMISDVGAFMKQIIIIAGGIISLTIMIAIFVAILVVSVFKEDTVAAWNNSRNVIENSSTQINDMFSFVKGKRDDVMARYQSLENSESCNQLVSKLDSVEKALAEGSLLLPRSSIEQIFAIKNSLNDSSSPAQSFACEQAIQFIDRINP

SEQ ID NO: 8123 - protein, 73 aa, Proteus mirabilis
FKAEKLRRIMGSACSSIAKRAFDTTAGTCKLILQPENLLAIKAADSAVVKSGCGATAPIICNTVTFSSVLVGR

SEQ ID NO: 8124 - protein, 406 aa, Proteus mirabilis
MKAERHKKIVNLIKGHGAVKVSVLAKELSVTKETIRSDLNTLAEKGIIKRCHGGAFIEFETLDKVAKKEIIQFLECNDQIDKINLAGQPAVNKVCVLGSFNVDMISYLPRLPETGESLLANKFIFSPGGKGCNQALAASYADAQVHFITKIGTDQFSDYAVNFISSSRIKTSTIYQTENHQTGTASIFVSEESGENIISIYSGANMDISSDEVKIQKDKIIDADIILLQLETNIEALKEIISIGNENNIPIILNPAPYNKIIDKLLPMLDILTPNETEASLLSGIEVVDLVSAKNAANAIYQKGVNKVVITLGSKGSLAYDGYKYIYSPAYPAVVKNTAGAGDAFNGALAASLAKGKQFSYALRYASAFASLAVETSNASEMPEDINVMHRINQTTYSQIVTQSPE

SEQ ID NO: 8125 - protein, 231 aa, Proteus mirabilis
RMGEAVMNLWQKLIMRRLYNEQHSEGGEGGGGTATEPTQETSATDKNEPPANSDDPNKSTEKENGGEQGKPADKKNDANKSDVGAPEKYEFKAPEEGQELDKGALEVFEPIARELNLNNEQAQKLVDVYGSKIMPAIQKQINDGWQKQTEQWAKTVKADEELGSNESIGAAQKALDTYGSDDLKLYLTETGLGNHPEIIRAFAKIGKAMSEDGLVTGNSNGSKSAADVLFG

SEQ ID NO: 8126 - protein, 221 aa, Proteus mirabilis
FYLEFCMDVDWGLMVAVLSMFFTMFIGVITIRYTKKSLGYTKKSTEIADESLRAAKKSVDTTIRIYRQQRINEYKNNKKAVIAYKKLISEELKENYIYLSNVCKFIDFYLLNYSFDKNYVGNSPLYSVVNNGDEVNMIFRKNTTFYIDEFLHDITKIDLQFSIKLIDLKRKINFSNELLMLMKVELDNNSHKRFSIDYKSELTLLLNQVKSIYYECTGENL

SEQ ID NO: 8127 - protein, 120 aa, Proteus mirabilis
KSLEAHVELAKLQLFLGVKRQTINNRLKANKLLAVKVGGEYRLPIFQFDGNRLVDGLDEILILLDSLSSTTKVSFLTSMYFFEDEQDINVIDALKKYGRMSEQMQEIIHQAKLFGKHISN

SEQ ID NO: 8128 - protein, 741 aa, Proteus mirabilis
VTMDITEFYQTFFDEADELLADMEQHLLLLDPQNPDQEQLNAIFRSAHSIKGGAATFGFVKLQQTTHVLENLLDSARRHEMVLTDDIINLFLEAKDIMQQQLDAHKNSQEPDEETFNYICEKLRQLALEVKEEQSTQLGEGNDSVSLTESNAPTENITPVSAVHHTDDELSKENQPLATANTPNTDGLYQHHIILSDLKETDIDLMLDELKHLGEVSQVEKQHHGLEAVLKTTATQEDISAVLCFVIEPEQISFANVAATEEKVTSTDKTQEQAEHSPSSVTESIQPAAQTEQPATIEKNVAELNKNSQADEVTKVATTLPPTATPAPARKPVVAQAKTESTSIRVAVEKVDQLINLVGELVITQSMLAQHSDTLEPSIHSDLLSCIAQLQRNSRDLQESVMSIRMMPMEYVFSRFPRVVRDLAGKMHKKVELNMIGSSTELDKSLIEKIIDPLTHLVRNSLDHGIEMPADRIAAGKPEAGQLTLSAEHQGGNICIEVTDDGAGLNRERILKKAISSGLAVSENMSNEEVAMLIFAPGFSTAEVVTDVSGRGVGMDVVKRNIQEMGGQIQISFEVGKGTRIRILLPLTLAILDGMSVKVNDEVFILPLGTVVSSLQPEEEDIYPLAGDEKLLQVRGEYLPLIELHRTFNIEGAQTDITQAIAVIVQSAGRRYALLVDKLVGQHQVVVKNIESNYRKVPGISAATIMGDGSVALILDVPELQRLSHSQMTEKKKNTTAHTVI

SEQ ID NO: 8129 - protein, 477 aa, Proteus mirabilis
YFTENNLMEITLLTMDVTATSPGTTSATTSQPGDNASTFAQLLSTQPQNTPSDKKNASISGHSSKENKAHNHTEKNKDQQNDDDIDTIVTEYAALEAPATKNTHLALSLPDNEQFSSILENKTASSLMSAEELAAELPVQLAGLAGLKSTSLSANQAHQPHLLGTSLKHAGNGNELSHLMAENARAERDLVDKWQQFNTQANADDKSLLAQLRPETASLTQLATHEARHLTNGHSAKKVDNASLLSSVAEKADGLLADDKASANTKLTDNLANQIIGNNRIAERDLHNRLSTSSVFASSSVASHAQPSSMMQAQMHFPSMPTPMLNAQIGTPEWQQQLNQQIVMFSRNGLQKAELRLHPEELGSLHIRMKIEDGQAQLHLASQNGQVRTVLENSLHHLRQALSENGIQLTQSQVSSDSHDGWQQQNMSDSSQFSGNGADNHQRSEGNSMQLASETAQKITLTPQELASARGGVDIFA

SEQ ID NO: 8130 - protein, 167 aa, Proteus mirabilis
RHKDIPMKIKSLIAISLLSVSASLFAAESTSTTQQVQGVTQAQKDLNDYEKVMVEKVWVTTQAIDEKGNKVDANNPQVSNYFGLAEYYPNGTFIMFTPEGKQKMQGDWSMSNDGKTRTLVAKDAQGKTLFTRDVENITINNDEYTYRIYPTEGDNTVYFDIIHHVKK

SEQ ID NO: 8131 - protein, 285 aa, Proteus mirabilis
RCKDRLYTLLHKGINLTGLINFANNILWGYVLIYLLLGVGIYFTIRTGFIQIRHFGHMFSILKNSHKSDKSGISSFQALCTSLAARVGTGNLTGVAIALTAGGPGAIFWMWVVAIIGMATSLIESTLAQLYKTKDDEGNYRGGPAYYMTKGLNMRWMGVLFAIFLIIAFGLVFNAVQANSIAQAAASAFNFDPLYVGIGLVVMSGFIIFGGLRWIARVAELVVPIMAIAYLLLAFWVVADHFERLPEVFMLIFKSAFGLQEAAAGAIGYGISSSDDPRYSTRPIF

SEQ ID NO: 8132 - protein, 728 aa, Proteus mirabilis
HNKELNMLSATRKTVTQGLTGAMMAILITATPTMAQTEKDVIMMPPKANKIPHVMTEHGDSRTDNYYWLRDDARKDKQVIDYLKAENAYTESVMAAGKTLENTLYNEMVERMAQNDASVPYDYNGYTYQTIYQEGKDFPIYQRKPIGSDGEWEILVDGNERAKGHEFYQLGDLAISPDNKRIAIAEDKEGRRNYTVAYKDLTDKTWQENVLTNISANLVWANDSQTLFYVDKDPQTLLPYQIYRHQYGSDRKQDVKIFEENDDRFYTWMEKSKSEDYILVTIASSTTSEYRLIDANAPEKPMVVFSPRQEGREYYIDHFKGEFYIRSNHESELYGLYKTASIDAPWQTVIAPQPEVDLESFELFNRWLVLEERKQGLVSLRQIDWKTGQSTNIIFDDPVYMAWLSVNPQADSEELRFGYTSMTTPSSTYQWNMQTKEKQLLKQQEVKGFKHDLYESERIWVKAQDGVEVPVSLVYRKDLFKKGENPILIYGYGSYGSSIDPSFSSARLSLLDRGFVYAIVHVRGGGELGKRWYNQGKMEHKVNSFTDFIDATKYLINQGYGAPKHVYAMGGSAGGLLMGAVINMAPELYRGVVAQVPFVDVLTTMLDASIPLTTGEYEEWGDPADKDVYFRLKSYSPYDNVEAKAYPHLLVTTGLHDSQVQYWEPAKWVAKLRELKTDNNLLLLETDMSAGHGGKSGRFNRLRDTAREYAFILMLEQPDIYFKTQNIK

SEQ ID NO: 8133 - protein, 138 aa, Proteus mirabilis
FPRDLTLNKILFVQYNRTGCKEMSTVELLKHIYDINLSYLLLAQRLINQEKASAMFRLGISDSMADALKELTLPQLVKLAETNQLICNFRFEDSETIEQLTKESRVDDLQQIHTGILLSSNLFRQLSEHDTSATKKRA

SEQ ID NO: 8134 - protein, 358 aa, Proteus mirabilis
IIGLGKYLMKLTIDNIKPYLLFETISGSRSQNLATDSSDTDIKGVFYLPKEMFYCSDYVPQVSNKTNDIVYYELGRFVELLCASNPNILELLNAPEHVVIYRHPLFMQFNPEWFLSKECVQTFVHYAQGQIKKAQGLNKKIMDPIDKELKTILDFCYIIEDGKSLLLNNWLKKRCWEQQNIGLVKINHAQNLYAVFYDPNSDYQGVIKKDNATDVLLSSVSETAILQAYLSFNKDGYSTYCKQYHAYWQWVEERNEARYQQNIEHGRSYDSKNMMHTFRLLYIALGIATEKKVKVWCDNRDELLEIKSGALSYETLFERSKILIEKIEQAFQQSQLPEKINPQLIKQVLVNIRKELYQ

SEQ ID NO: 8135 - protein, 258 aa, Proteus mirabilis
IYSLNFNINLVGFLLLNEYNTMNNQSKKYDRTYHYPFSPGTTSDDRINANWWQDICKIKHLIHTEKLDGENNCLNRMGVFARSHATPTQSAWTVQLRQRWQSIRNDLGNLDIFGENLYAIHSIEYQHLEEYFYVFAIRCQDKWLSWEEVQFYATLFDLPTVPEISLPKSENKIEFEKNIILHAQKHSSFQSRDVLTKKPSAMEGIVTRDAQAFSLDEFSHRVFKYVRKDHVKTDVHWKRNWKRAPLIWEKTQESHDAS

SEQ ID NO: 8136 - protein, 117 aa, Proteus mirabilis
HLTLIRDNRDNLGVFIMQRKMKVTCFLLMLTSFALLTGCSQSKQAQNTTAQVINSNKTIATTPSIPLEEPAKETCIFSGGVPALTYELHGGQTPVCQFANGKRCSEQALIDGACIPG

SEQ ID NO: 8137 - protein, 61 aa, Proteus mirabilis
RITLLAPLLYSHLLCFFSCWIRIKHLFLLTSLSEFVTINSLFVIQTLFLQDNYLVIRLNIE

SEQ ID NO: 8138 - protein, 572 aa, Proteus mirabilis
KGKLMFSRMKIVTGLLSILLLFGVLQFISGGVFYSNLSETRQDLDKTLTIQKQRERLDESWANLLQARNNINRAAISYLLQDKDLNVDSSLSVEYLTGLARKNMSRADDKFKEFEQHINAYQIHSQEEIRNLKGRFIEYFSALNQLEILLQDKNLKDFFEQPTTSYQDGFYKEYLAYVMRNEKFNNQLNSALEASHQRSIITMVILAIIVVTALIICWFALRNALIRPLNSLLLNIKAFSEGDLRPDIEVHGRNEMSLLASGLKHMQQELIHTVRGVYQSTENIYNSTSEIAAGNNDLSSRTEEQVASLEETAASMEQLTATVKQNADNARQASNLANDASDIARQGGKVVANVVQTMHDIAGSSQKITDITAVIDGIAFQTNILALNAAVEAARAGEHGRGFAVVAGEVRNLAQRSAEAAKEIKTLIEDSVSRTETGSVLVESAGETMTRIVESVTRVTDIMGEIASASDEQSRGISQVGLAVSEMDRVTQQNASLVEQSAAAAAGLEDQAVALTRLVSIFKLPGQEEKALEKKELDALPVVQAAAPLIKPGTSEKKKSSSVEDPANWETF

SEQ ID NO: 8139 - protein, 192 aa, Proteus mirabilis
ERPWNSSISPGDSSVPANIEPTITHAAPAANALAISPEKRIPPSAITGILRSFSASTASAIAVICGTPTPVTIRVVQIEPGPIPTLTALTPASASAKAPSAVATFPPIIGKFGYKARVSRIRCNTPSEWPCEESIRRTSTPAATNAAIRSSLPAPAPTAAPTRKRPCSSLHALGLRSAFLKSLTVIMPFKWK

SEQ ID NO: 8140 - protein, 61 aa, Proteus mirabilis
GVTCDNTEPPIDHSPAKAVGVLNPAIMAKEITIFFLLTMIFHIVFDKTVTKKRLLLWCTKS

SEQ ID NO: 8141 - protein, 150 aa, Proteus mirabilis
DAYCIKLNIYGDGEFMLKKMMGFMFLAVAMMTLSACGDKQDEAGKAAVEFIEAVASGDGDKAVSLMYFGDLEKDPMAEQITGKFKMIVAEAGKKIKEQGGLGKVEVAKVEYSEDKNKAVVTLKTVLKNGEEKTENQNMIKVDGKWKVEVK

SEQ ID NO: 8142 - protein, 218 aa, Proteus mirabilis
THNCTSLVGGQLCVYGNTPTEAIVMSFYATIILALALSMDAFAVAVCKGATLHKPHFREALRTGFIFGIIEASTPIIGWALGLYTSQYIIQWDHWVAFGLLVILGGRMIYQSLKRGDDCICEEAPQRHGSLSLIATGIATSLDAMAIGVGLAFLQVDIVHTAMTIGMMTMIMATLGMLIGRYIGPVLGKKAEIIGGMVLIAIGFNILFEHLDLFMYAH

SEQ ID NO: 8143 - protein, 1051 aa, Proteus mirabilis
SRCCGESIMSEKIPATGGGPSRLFILRPVATTLFMVAILLAGIVGYRMLPVSALPEVDYPTIQVVTLYPGANPEVMTSAVTAPLERQFGQMSGLKQMSSQSSGGASVITLMFQLTLPLDVAEQEVQAAINAATNLLPTDLPYPPIYSKVNPADPPVLTLAVTSSVLPMTQLQDMVETRISQKISQVNGVGLVSLAGGQRPAVRVKLNAQAAASYGLDSETIRVAINNANVNSAKGSLDGPTRSVTLSANDQMKSLDDYRKLIVSYKNGAPIRLADIATIEQAPENNQLGAWANNQQAIIINVQRQPGVNVIETTDNIRNLLPDLVSNLPKSVNVEILTDRTTTIRASVKDVQFELGLAIALVVMVIYLFLRNGVATLIPSIAVPLSLVGTFAVMYFCGFSVNNLTLMALTIATGFVVDDAIVVIENISRYLERGDKPLTAALKGAGEIGFTIISLTFSLIAVLIPLLFMGDIVGRLFREFAITLAVAILISAVVSLTLTPMMCARLLKPESQIKHNRFEMACERFFEKMIAVYAVWLKRVLNHQWITLGVALSTLALTVLLYLFIPKGFFPLQDNGLLQGTIETSQSISYQAMVEKQQQVVEKLIDDPAVENIASFVGIDGSNATLNTGRLQITLKPLDQRDSRIDEIIPRLQARVASIAGITLYLQPTQDLTIDTQVSRTQYQFTLQATSLDELAYWVPKLSQALQESPELTDISSDWQADGMMAYINVDRDSASRLGISMSAIDNALYNAFGQRLISTIYTQANQYRVVLEQNMHNSEGLQALSAVHLTGKEGAMVPLLSIASVEQRLAPLSINHQEQFPATTFSFNVAKDASLEAAVNAVKQAEEQIAMPKDITTQFQGATLAFESALSSTLWLIIAAIVAMYIVLGVLYESFIHPITILSTLPTAGVGALLALMAAGNELDIIAIIGIILLIGIVKKNAIMMIDFALAAEREQGLSPYEAIYQACLLRFRPILMTTMAALLGALPLMLSTGVGAELRQPLGVCMVGGLIMSQILTLFTTPVIYLLFDKLSLYLNRHKRVEHDNGAVS

SEQ ID NO: 8144 - protein, 67 aa, Proteus mirabilis
HTTCIIKIALEKNVYIYYSFSLNFFRYLTLHDDCSSILNRVTTLIMSLYGYLYLNNDKYLNPQSLFT

SEQ ID NO: 8145 - protein, 273 aa, Proteus mirabilis
LIYWHSRNDWLITMITLTSEILNGYISDFFWPFVRILALFSTAPLFSEKQTPKKFRIGLAFLTTALIAPGLPQSQVPLFSIMAFWVLIQQILIGTILGLSMQLAFASVRHAGEVIGLQMGLSFATFVDPSGGPNMPILARIFNMLTMLLFMVFDGHLWLLSILADTFYVVPIENQTFNSLGILTLVQSGGTIFINGMMLAMPLITLLLVLNLSLGILNRMTPQLSVFVVGFPLTLTIGMLALSMIMPALPVFTERVFSDTFNRITLILQQLVS

SEQ ID NO: 8146 - protein, 496 aa, Proteus mirabilis
LSGCCCMKLRLKKPLVALLVSTLLSTSVLPAHAAIDIEDTLPDMGTTAGSTLSINQEIAMGDYYTRQLRNSAPLVFDPLLSNYINNLGQRLVSNASSVKTPFHFYLVNNPNINAFAYFGGNIVLHSALFRYSRNESELASVIAHEISHVTQRHLARMLEDQSKTTPLAMAGILGSILIFMANPNAGLATFTGSMAGMQQNMITFTQMNEQEADRIGIQTLYRAGFDPQGMPNFMQILADQVRYSSKPPEMLLTHPLPDSRLSDARSRAAQYAPRKVPQSANFLYAKMRVLTMLEKNPASSNALQTTLDQFRQGTELEKSAANYAQALLYSRDRKFNDARKILAPMLAKEPNNIWLIDAITDIDVEQNRAAEAITRLQQALKQSPNNKVLTVNLANAYMQNKQYNEANRLLYRYTFDNPDDPIGWQLVAENAAKQGNRAQELAAYAEDLALRGDFETAIRYLGDASRQVKLGSNEQARFDARIDQLRKLQHKDSQFK

SEQ ID NO: 8147 - protein, 712 aa, Proteus mirabilis
TCQCLPHWTLLEKIIVMANLASLLRLPGNWKSSQWQILAGPVLILLILSMMVLPLPPFLLDLLFTFNIALSIMVLLVAMFTRRTLDFAAFPTILLFTTLLRLSLNVASTRIILMEGHTGSAAAGRVVEAFGHFLVGGNFAIGIVVFIILILINFMVITKGAGRIAEVGARFVLDGMPGKQMAIDADLNAGIINEEEAKKRRKEVSLESDFYGSMDGASKFVRGDAIAGLMILVINVVGGLVVGVAQHNMALNDAASTYTLLTIGDGLVAQIPALIISTAAGVIVTRVATDEDVGQQMVTQLFDNPRVLMLTAGVLGLLGLVPGMPNFVFLFFTAALAGLGWYILKRHSSPQVQQQKELEQVEKQNRVVEASWEDVQLEDPLSMEVGYRLIPMVDNRQNGELLGRISGIRKKFAQEMGYLPPVVHIRDNMEVKPSSYRILMKGVEIGHGEAHPGRWLAINPGNAVGTLEGDNTQEPAFGLPAVWIDDSLREQAQVQGYTVVAASTVIATHFNHVLNQYASELFGRQEAQMLFDRVSKELPKMTENMIPDMLSLTVLHKVLQNLLAEQVPIRDMRTILEALAEHAPEQKDPAELTAVVRVALRRAITQHWFGDKEEIQVIGLDAGLERLLLQAMQSGGGLEPGLAENIEQQALDAVRRQEMSGGVPVLLVNHALRSLLSRFLRRSLPQLAVLSNMEISEGRHIRMTSMIGGQNH

SEQ ID NO: 8148 - protein, 65 aa, Proteus mirabilis
KLILNQKTHFKIMLSRFGGVAFLLKTHLMSLLIVLAHKIVTKGLKTRCIYLHASIENFGVVHITR

SEQ ID NO: 8149 - protein, 115 aa, Proteus mirabilis
CLVRYGWWRCSMTHPFDAYEDERIARTEYDIQQKNRQEKEEQQLKEVMSTEAGRAVIWRLISDSGVFRSSFSNDPYAMAFREGERNYGLKVFNQLHQVCPELYAQMANEATTPSV

SEQ ID NO: 8150 - protein, 584 aa, Proteus mirabilis
YSSRTTRQGLSMNAEKTDVVNQKKGFNAIINRIKADPKIPLIIAGSAAIAIFVAAFLWLQSPDYKVLYSNLSDKDGGEIVTQLTQMNVPYRLSQNGSAIMVPDNQVHELRLKLAQAGLPKGGAAGFELLDKEKFGISQFSEQINYQRALEGELARTIETLGPVQNARVHLALPKPSLFVREQKSPSASVTVGLLQGRALDEGQINAIVHIVASSVAGMPDSNVTIVDQSGKLLTQPDALGRDLNSIQLKYVQELESRYQQRIETLLGPIVGRGNVHAQVTAQVDFSHTEETAEEYKPNQPPNQAAVRSKQVSQSEQNGGMLAGGVPGALSNQPIAPPQAPIEKAKDTAADEKATSTNANRSMTRNPNSNSRLDETTNYEVDRRIRHVKRPVGNIERLSVAVIVNYKTVEDKKKATEGEEPIVENKQVPLTDEQLQQIESLVREAMGYSQERGDSLSVVNSQFNDTEEPVISVPMWENPQILAKALDLGRWLLLVIIAWILWRKLVKPQLEKRREAEVAAQKAILKTKLEVTDDVNEAELDEESRRKQARQRVSAELQSQRIREMAEKDPRVVAMVIRQWMSKEQ

SEQ ID NO: 8151 - protein, 63 aa, Proteus mirabilis
ISVLPLNMSGIILAFDYFLVILLNGVNNDLKHQLLYFNCAFCLPFLFLFCKPPIINSFLSLNS

SEQ ID NO: 8152 - protein, 184 aa, Proteus mirabilis
VIIRFTLALTLYLASTLTVLAFPYQLKSGDLVFRDGDEVISDIIKQVDNSGFSHVGMLWITEQGIQVVHSTPSEHADSKDGVTIDSLDFFISRAKPNSVRFYQVRGSEQARQQALEAVLNRVGENFSIQQDKGVYCTELVADAWLKAGVSISTGTRTLHMPFISERALIFPDNIIHSENVILIE

SEQ ID NO: 8153 - protein, 249 aa, Proteus mirabilis
QKKRFGRNKNMVIKAQSPAGFAEEYIVESIWNNRFPPGSILPAERELSELIGVTRTTLREVLQRLARDGWLTIQHGKPTKVNNFWETSGLNILETVARLDHDRVPQLIDNLLAVRTNISAIFIRTAFKNNPEKSLEVLTHQLTTENSADEFSELDYNIFRGLAFASGNPIYGLILNGLKGLYTRVGRYYFSNVQAKELALSFYKKLALLCEQKDTEHVMDCVRQYGKESGIIWHELQSPLPSDLEEVKR

SEQ ID NO: 8154 - protein, 142 aa, Proteus mirabilis
PYERNAGGGTRMKQKIYYINPVPKPRMTQRDAWKKRPVVVKYHAFCDEMRANRFMLPESGAHLTFVIPMPKSWSKKKRIEMNGKPHQQRPDVDNLIKAVMDAIFDEDCRVWNISASKLWGEQGKIGVTLPENTENHELITIR

SEQ ID NO: 8155 - protein, 130 aa, Proteus mirabilis
PKRRLITDSVQGCKQEIDMTDKLKEEISSIMDRAAMGNATVCILNRFANTVQIAAFLISKGKVKEATDWLYGALEWDSEVDIFGDLKDSDGNSEDIQTWFDKQIEGEISFAEAIELIRKHYTELEKLRTA

SEQ ID NO: 8156 - protein, 289 aa, Proteus mirabilis
LTALSEWCFMRDYGKVSPQFWIGKTGKEIREKGHEALIVSMYLLTNPHANMIGMYYLPIIYMAHETGLGLEGASKGLLRCIEAGFCHYDEDAEVVWVIEMAKYQIASSLKPSDNRCIGIQREYDSQPKNQFLSMFYDKYKDAFNLSSARESSIKNERGLEGALKTLRSQEQEQEQEQDIKPPKSPLKKKSVQKRGFNILEEKIPDWLNPEVWEKWIEYRKEIKHPIKSKQTFSGQIKLLTECYELGFSPEEIISKTITNGWQGLFKPNVSPPQRIIQPQKNDEFIPEDF

SEQ ID NO: 8157 - protein, 356 aa, Proteus mirabilis
TIRRTLGVNIMSEVATLERNQSVMNNTSLLFNPESLDRIVKFAELMASGTATVPRHLQGKPSDCLAITMQSARWGMDPFVVGQKTHVINGVLGYEAQLVNAVITSSNAVVGRFHYKYGGDWEKIVGMKDKRDESGLFIEVGAILRGEEEITWGEPVYLADVQTRNSPLWKTMPKQQIAYLAVKYWARLYCPEVILGVYTPEELEDRPIKDITPQKERVSINEITNQQQPNNAEPVKEAQGEFIPKFDAEAFRLAIDDVQTVEEAKNIRAEIENLKNEMGINLFTELKNKAVQAYHRIDARNALEASINSLPESGSPEATEAFEKVDKLLKSSKRKLGDELYESFSITLDDMRPEYQ

SEQ ID NO: 8158 - protein, 442 aa, Proteus mirabilis
SNIFRLYFVTKTKWTCIRNTQCLPRRILVSFFMDQSIIDNMKRLQAFKFQLRPNGQQEREMRRFAGACRFVFNRALARQNENYEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYRNSREVVGEVRNVTVSQSCGKWYVSIQTEHEATEPQHGSTSIVGLDAGVTKLATLSDGTVYPPVSSFKVNQRKLARLQRKLSRKIKFSANWQKQKRKIQRLHSHIANIRKDYLHKVTSEISKNHAMIVIEDLKVSNMSKSAKGTTERPGRNVKAKSGLNRSILEQGWYEMRRQLEYKQLWRGGQVLAIPPAYTSQKCACCGHTAKENRQSQSQFECLECGYTANADINGARNILAAGHAVLACGGRVQSDRPSNQEPAEVIQTSV

SEQ ID NO: 8159 - protein, 347 aa, Proteus mirabilis
FKFRALFYTTSTSIMPINITKERGLLISLLTVIASCLLLIAYYWSELTYFNVQWQKVINSYLAELMQDISENNWQVGFILIGVSFLYGLLHAVGPGHGKVIISTYIATHPTKLKQSAWLSVLASLLQGTVAIVIITVILIILNLSSSHLKIASHYIENSSYLLISLSGIIIFIQSIRRLLSDYKKRAFYIKQATPIIKRSRYLYKHKSNQTISQTSCCGHKHVVTSNELQGNWSAQLLVLFAIGSRPCSGALLVLLFSYALNIYLWGIAAVIAMAIGTALTITAIALTVYYMRNVAYRFSVKNTNLSFRYMAELLRLLAGILFIFLGILMFNSAITLNREDIMPLFR

SEQ ID NO: 8160 - protein, 217 aa, Proteus mirabilis
LSISKSTPMKNIVVLISGNGSNLQAIIDACRAHKIAGQVVAVFSNKAQAYGLERARQADIPAYFIDPADYPDREAYDKALITQIDGYQPDIVVLAGFMRILSPLFVNHYQHKLLNIHPSLLPKYPGLHTHKQVIENKDTFHGTTVHFVTEELDGGPMIIQARIPVSPDDTEQSLQAKIQTQEYRIYPLAISWLAEERLKMIDNRALLDGNVLFDNLD

SEQ ID NO: 8161 - protein, 66 aa, Proteus mirabilis
NVTSSLFSDIFTDVYGSFFIKFIKLNISSYIKIDASNSNLNVFFTAIPLLFNLSFSILLLFLFCAK

SEQ ID NO: 8162 - protein, 104 aa, Proteus mirabilis
SWCSLGVTMQGTNSTKSIQLEVLYMGKDCICVIFLKGPAPVNVLQDIETQLLEVADEHEMFTKHGTYQISVTRDNGEYDGLGNCYNAPYWDFDIQSFEPMPEGE

SEQ ID NO: 8163 - protein, 476 aa, Proteus mirabilis
KHFRYCMEEQTEVTQPVRVKNATLQRGLTNRHIQLIAIGGAIGTGLFMGSGKTISLAGPSIIFVYMIIGFVLFFVMRAMGELLLSNLEYKSFSDFAGDLLGPWAGFFVGWSYWFCWVITGIADIVAITSYISYWAPNFPEWGTSFICVLTLLILNLATVKLFGEMEFWFSMIKITAIVSLIIVGIVLISINFQSPAGHTATIENIWNDGGMFPKGISGFFAGFQIAIFAFVGIELVGTAAAETRDPEKSLPKAINAIPIRIITFYVLALAIIMSVTPWRSILADKSPFVELFVMIGIPAAASLVNFVVLTAAASSANSGIFSTSRMLFGLSKEGEAPKQFSQLSKRSVPANGLLFTSLCLSCGIVLIYFIPDVMRVFTLVTTVSALLFMFIWSMILCCYLAYRKKRPQLHQQSIYKMPLGIVMSWLCLAFFVFMVVLLAFEHDTRQALMVTPIWFIALGIGYHFVKKRKQKAQLKN

SEQ ID NO: 8164 - protein, 468 aa, Proteus mirabilis
LEIRTRKLIMFTPELLSPAGSLKNMRYAFAYGADAVYAGQPRYSLRVRNNEFNHENLAKGIQEAHELGKRFYVVVNIAPHNAKLKTFIRDLKPVIDMGPDALIMSDPGLIMMVREAFPDMDIHLSVQANAVNWATVKFWRQMGLTRVILSRELSIDEIAEIRKQVPDMELEVFVHGALCMAYSGRCLLSGYINKRDPNQGTCTNACRWEYKVEEGKEDEVGNIVEKYQPIPVKNVEPTLGVGAPTDKVFLIEEAKRPGEYMTAFEDEHGTYIMNSKDLRAIEHVEQLTKMGVHSLKIEGRTKSFYYCARTAQMYRRAIDDAVAGKPFDPTLLTTLEGLAHRGYTEGFLRRHTHDAYQTYEYGYSVSDTQQFVGEFTGKRVNGLAEVDVKNKFILGDSLELMTPTGNIQFTLDALFNKKQQPTDVAPGNGHVVYLPVPDDVDLNFALLIRNLPGTTTRQPHKIDAVEVK

SEQ ID NO: 8165 - protein, 420 aa, Proteus mirabilis
RVVSRITNAMNNNKKTKKRFSLIITLLIVIAGAIAYWQYSSNNSAPPVSKDTPTANTPNRSTAGSRRPPMPPVQVATSAQEDVPQFLTALGTVKAVNSVTVTSRVEGQLMALHFTEGQQVNQGDLLAEIDPRPFEVQLAQAKGQLAKDQATLANARLDLARYQKLAKTHLVSQQELDNQAALVKQSEASISIDKAAINNAQLQLTYSKITAPISGRVGLKQVDVGNYISGGSSTPIVVINQMDPVDVLFTLPEQDLSQVILARKNSPTLPVIALDRNNKIELAQGTLFSVDNQIDATTGTIKLKARFPQQESTLFPNQFVNIRLYVTTLEKAVVIPNAALQMGNEGHFVWVVDEENKVSKLAVEVASQNADKVVIASGLSANQRVVTDGVDRLTQGAKVEIVTPLAPKAKTTDPVVAEKA

SEQ ID NO: 8166 - protein, 167 aa, Proteus mirabilis
NCTSYWDSRHVKPLVEQFGIPFLLISHEGLTVVQHDEKLIAQIDQYKPDYVVLAKYMRVLTPAFVQHYPNQIINIHHSFLPAFIGARPYHQAYERGVKIIGATAHYVNDNLDEGPIITQNVINVDHTFSAEDMMRAGRDVEKNVLSHALYWVLSQRVFVYGNRTIIL

SEQ ID NO: 8167 - protein, 64 aa, Proteus mirabilis
STSSVFIQLIVQESLPCLAIIKTVNKSFNIGLFCLSLPLIVIFNVLQGDTYRAIFQRFTSNNLP

SEQ ID NO: 8168 - protein, 190 aa, Proteus mirabilis
FLGRITTYFNIIMDIVMLSALRHWSQSRFSWLLLALTAIGLEGAALYFQYGMELMPCVMCVYQRIAVLGILVAALIGFSLPKLTLMRMAGSFLWLYASYRGIELAWEHTQLILNPSPFATCDFFVTLPSWFALQDWFPAVFQASGDCSVSQWRFLSLEMPQWMLIIFSAYFIVGLLVLISQVTSSFSKKD

SEQ ID NO: 8169 - protein, 81 aa, Proteus mirabilis
ELISESTQIKILMIIFYFIRSIKLINLKIQHKKLTNLKLKFFSITVTYIAIAPPHLCLNKALVFNKYFYRYSFFSHLPKTP

SEQ ID NO: 8170 - protein, 300 aa, Proteus mirabilis
IMVSNNFDFTGSMVALVTPMDAKGNVDRVSLRKLVDYHVKAGTDAIVSVGTTGESATLSHDEHVDVVLMTLDMADGRIPVIAGTGANATSEAIWFTQQFENKGIAGCLTVTPYYNKPSQEGLYQHFKAISESTALPQILYNVPGRTGCDLLPVTVARLAQLDNIVAIKEATGNLSRVSQIQQLVNDDSFILLSGDDASSLDFMQLGGHGVISVTANVAALEMVELCRLAKAGEFAKARELNRRLMDLHHQLFVEPNPIPAKWACQRIGLIEDATLRLPMTPLTSAGQDIVEKALLTAGIL

SEQ ID NO: 8171 - protein, 828 aa, Proteus mirabilis
IHTSEVVIMPFSLIQPSFSGGEIAPSLYGRVDLAKYSTALRKCHNFIVRQYGGAENRPGTRFIAETKYQNKKSRLIPFQFSTVQTYALEFGDRYIRVFKDGGQVLYADGEHKGEVFELATPYKEADLFDLKYTQSADVMTIVHTDYPPMELQRYDHDDWKLVSVETKNGPFEDINTDKAMKVYASASTGQITLTSTHDIFGTEQIGKQFYLEQRDIDAVPVWETDKTTNLNDQRRADSNYYRANSGGKTGTLRPSHTEGMSWDGWGGDTGIQWEYLHSGFGIVKIETVSEDGKTATGKVISYIPSNAVGEDNASHKWARAVWNDVDGYPSTVVYYQQRLFFAGSRAYPQTIWASCSGDYKDFGRNNPIQDDDRIIYTYAGRQVNEIRHLIDVGSLVALTSGGEYQITGDQNKVLTPSSFSMSSQGANGSSDLPPISVANIALYIQEKGSAVRDLSYSFDVDGYQGTDLTMLANHLFQRHRIVDWSFTTVPYSIAWCIRDDGLMLALTYLREQQVFAWAPQSTEGKFESTCSISEGNEDSAYFIVQRTVNGKQVRYVERLASRLFTSTEDAFFVDSGLSYDGRNTDISKTATITGGAGEWNYQENYPLVISGDPVFSASDIGSAVNIPYFEDNEHKELRCKIVQYISANQVVISANRNIPPALQNTPTTEWSIARYRFAGLNHLEGKTVNILSDANVSPQAIVTNGAVEIDTPSAVVHIGLPITSELETLDIHINGQETLLDKKKLIKVASLIVNSSRGIWAGTEKERLYEYPQRQFEFYDNPVDDATGIVEINLDADWSKNGRVFIRQVDPLPLAVLSVIPRIDAGGF

SEQ ID NO: 8172 - protein, 1034 aa, Proteus mirabilis
STKRILIMPKVPTYDNRTVMPEQLPNNGFSVQSSPDAFGAGIGRVGEQYVGLFAEAKQRANVALAQDAALQLRQKANELMTDPQNGLLSQQGKNAIGKAFEYEQSFRDYADEISSTLPDDIVRQSFMQQAQEMGVQFASQANRHEMGQIKAYEQDQFKSTLTLNAESAASMYGDNQAYISAHKQVFQQIEEFGLSHGWGEEQILAKKQEFKVATARKAIENQLGADYMGFLERNGEPSSLGGATRNNAFYGGTVSKVKGMTQQGNINLLNRPTVKNEDGSISTVRTISIGTDDGEVLIPTVSDDGKLLSDDEAIVLYEQTGKHLGIFDNPEDATAYADNLHKQQENMYTPSNGDTRGVRNNNPGNIRISSNKWVGQTGDDGAFAKFATPEHGIRALGKNLLSYARQGFVTPEQIINRWAPPEDNNDTQAYIEYVSDYLGVAPNQPLDLTNLDTLTHLSTAIMYKENGRNRVNYTDEQIATGIQSALGFVELQATSEAPKLLTGSAAFDALDEADQAKYLRQAEQLRKQKQSELQQQFGTRVADSYAAWERGLDAPNAPTHDELISAFGYDKGSAMSADMQEAKRYAGFMSAAKEMSPQAQQALLSQIRPQTGEANYESKIQRWEKFGKFVESNIKEQDKQFAANRLQLSIQNNFPLDPNDKNNQQAADDYFEQHIQQSFNLRDDNSLNAVAELTARTGIIPSQVKSVLNMGATSKDPEVVLPIAKMYGQIFDNNPASATDIPSSTMAYYSKVYSLSRAGMPDEKAVETAFKTTFEQDERTKQMIASQIRDKGYIKDRDKAAQSNINDFYPWYKPFSSPSVSKPGAQNGAYLRDYQTLYDANFAETGGDAELAKKMTNAQIKRTWAVSNINGSEEVMRYAPEAVYGINESGAGNWIAGQWEEEKKQLMSKSFGGASSGTEIVIVSDAVTPRDYSYGIMIKQTGSDDIPIYRPYTGDNGLPIRFKPEQSSSPMYKEVMEKRQQSVKEAQDKREREEALDKSRSEFDERRQSIREQYKEAHNERVNKFNNYFSWDKN

SEQ ID NO: 8173 - protein, 493 aa, Proteus mirabilis
ELKRNNMSQSAINNDTAAAINPYSQKVAHLRQQILNIFLEDDRFVETVLGEASESDRLSHHELHEKITTVRELLQDLHAADIADILEALPYDERLALWHLVDNNERGAVLVEASVAVWDSLIKDMTDRELLRSVASLHVDEQAYIAEHLPRDTMRRLLTYLEPSLRNRIREVLQYPKDSVGQMMDFEFVTVRGNVTLKTVQRYLRQRGSIPEATDKIFVIDNANHLLGELPLTTVLTQSPDKRVSDVMKTDTVSFMPEEKGEDAAGAFERYDLISAAVVDSNGLLMGRLTVEDIVDNMHEESDTNIRRMGGLSPEEDVFAPVGQAVKTRWTWLAINLCTAFVASRVIGVFEHTISQLVALATLMPIVAGIGGNTGNQTITMIVRALALHQIQTGSFSFLILRELGVALINGIVWGGIMGVVTYFLYGDIAMGAVMTMAMVLNLLMAALMGVLIPMTMIKLGKDPAIGSSVMITAITDTGGFFIFLGLATIFLV

SEQ ID NO: 8174 - protein, 466 aa, Proteus mirabilis
MKKRGCMAKESQQAELKRGLKNRHIQLIALGGAVGAGLFLGIAQTINMTGPSVILGYAIGGFIAFMIMRQLGEMVAEEPVAGSFSHFANKYWGPFAGFLSGWNYWVMFILVGMAELTAAGKYINYWLPDIPVWVSVAVFFVAINLINLINVRMYGETEFWFAIIKVLAIVGMILFGSYLLVSGNGGPQASVSNLWELGFFPHGFTGFMSALAIVMFSFGGLELVGITAAEAENPKVSIPKATNQVVYRILIFYIGSLIVLLSLYPWTQVVKGESPFVLIFHNLDNFVVAHILNVVVLTAALSVYNSGVYSNSRMLYGLAKQGNAPHSLSKVNKRGVPVISLGLSAIATSLGILVNYLLPDQALELLMALVVTTLVLNWIMICLANLKFRAAKIKEGVEPSFKALWYPYGNYLCLAFLCMILVIILMMPKINISVILMPFWVGLLWIGFKISRTKKSLTTTQARQDS

SEQ ID NO: 8175 - protein, 356 aa, Proteus mirabilis
CNERRVIMKSNSQIIRVKKRGKKQHNAQHGAWKIAYADFMTAMMAFFLVMWLLSIASPQELTRVAEYFRTPLKVAIEKGRVSGDVTNPIPGGGRDPVYNEGDVLPKGVEDKQLNEKQQFRKLKENLEQVILQDPRLKDLKPHLLIDMMDEGLRIQIIDKESRPMFKVGSATVEPYMKDILTAIAPILNDSPYKISLSGHTDDIPYASGALKYSNWELSTDRANASRRELIGAGLAEWKVLRVVGMASTVHLVKEDGFAPANRRISILVLTKQEEKKIVHENERVAPAIKEASEIKPLLSGQETPQENGENTQTNSSVSSSTSKLPESKKENVETGVSGESLPSQSTNITTKQETTP

SEQ ID NO: 8176 - protein, 125 aa, Proteus mirabilis
NLRRHSERSYFMTAKSPAERKALQRKRQKELGVTKIELLVDNQELEMLKRNCVLRMPGRESYDVVEYIQMLIRKDDAEYKRQAEELSKSKCERCGEQLPVQQCCLSGDAKCWVTKGWREMMLKVE

SEQ ID NO: 8177 - protein, 334 aa, Proteus mirabilis
RTMSNDLTGTEKSAVMLLTLGEDRAAEVFKHLTTREVQQLSIAMSSMRQISNQQLIDVMASFEEDAVQYAALNVNANDYLRSVLVKALGEERANNLLDEISETRETTTGIETLNFMEPQMAADIIRDEHPQIIATILVHLKRGQAADILALFDEKLRNDVMLRIATFGGVQPSALAELTEVLNNLLDGQNLKRSKMGGVRTAAEIINLMKSQQEENVITAVRDYDGELAQKIIDEMFLFENLIDIDNRSIQRILQEVESESLVVALKGCDQELRDHFLNNMSQRAAEIMRDDLASRGPVRMSQVEAEQKAILLIVRRLAESGEVVLHGGDDTYV

SEQ ID NO: 8178 - protein, 95 aa, Proteus mirabilis
LAKRFFMTPESVLALGTEAMKIALSLAGPLLLSALVTGLVISMLQAATQINEMTLSFIPKILAVLAAILVAGPWMLSLLLDYMHNLFTGIPGMIG

SEQ ID NO: 8179 - protein, 440 aa, Proteus mirabilis
IIWSLAMKVIILGGGVIGVTSAWYLVQQGHEVIVVDRQSSAAEETSAGNAGQISPGYATPWGAPGIPLKAVKWMFQKHAPLAIRPDGSLFQLRWMWQMLRNCDASHYAMNKSRMVRIAEYSRDCIRQLRQDTGIEYEGRQGGTLQLFRDQKQFDNAANDIAVLKQEGVAYELLTAEQLKSAEPALEHVSHKLTGGLRLPNDETGDCQIFTKKLAKMAEEAGVTFLFNKEIKHLLFDGDKVTGVQCHDGLLTADHYVVAMGSYSTEFLKNKITIPVYPLKGYSLTMPIIDASRAPTSTILDETYKIAVTRFDNRIRVGGMAEVVGFNLNILKSRCETLKMVVQDLYEGGGDISKATFWTGLRPMTPDGTPIVGPTAYRNLSLNTGHGTLGWTMACGSGQLLADLISGNKTAIAADDLSVFRYIDGFNTKLLRPGQKLDAVY

SEQ ID NO: 8180 - protein, 217 aa, Proteus mirabilis
RMRRMKKYDLIYCDPPWDYKNKVSNGAAKNHYPTTSLFNLTHIPIHSITSDNAVLAMWYTGNFVLEAIKLAEAWGFKVRTMKAFTWVKFNPLAWQRIDKAIQNSELFDYHDLFELLDAETKMNGGNYTRANSEDVLIATRGNGLQRISASVKQIVFSCLGEHSEKPWEVKNRLEQLYGDVSRIELFARDMSQGWDAWGDQCPNNSIELINSHFICKE

SEQ ID NO: 8181 - protein, 104 aa, Proteus mirabilis
LSYGVLNKQITLLVKYLNGYYYLLVNQIGEIMEVFDFKKFWNSLTIKQREAFSQRTGYSQLYLSHQLRYAKRKPSLSKLNKLYDICVEFGADATREQLINFFIR

SEQ ID NO: 8182 - protein, 412 aa, Proteus mirabilis
FNNGGRMSFSQAVSGLNAAAANLDTIGNNISNSATYGFKGATVSFADVFAGSGAGLGVKVSGISQNFKDGSITTTNRPTDVAISGGGFFRIEDSNGGVFYSRNGEFGKDKNGYLTNMQGMRITGYPVQNVDGKNVVQKGATPTPIIIPTDMMNASATDKMDMTVNLNSAEEAIDQTTHKFDPKDNDSYNFSTNVTTYDSLGNEHNLNLFFVKTKDNEWSVYAQDTTTGEPAQDLGKLVYKDNGVLDETAPKLKNFTTVAYKGSQPMDMEMNFSGSTQQKVAESSVSKLAQNGYQAGEFTNFRIEPDGSIMATYSNQQSQVVGQIALANFANPGGLSSQGDNMWSETNGSGSPIVGVAGSGVFGKLTNNALEASNVDMSQELVNMIVAQRNYQSNAQTIKTQDQILQTLVSMR

SEQ ID NO: 8183 - protein, 208 aa, Proteus mirabilis
LANGWKIMNVIDAVKNRRATKQFDADFKIPQEEKKALLEDALQYTPSAFNLQHWRLLVVDDVKQRQALRKVGWDQPQITDSAMLIVLCADLNVWESEVKTIWQDANPEVRDIMCSAVDSYYRNKPQVQRDEIMRSAGLFAQTLMLLAQERGFDSCPMDGFDFAEVAKTINLPDHYAICLMIAIGKGKGKPFPRLGKLSFDKAVTFDHF

SEQ ID NO: 8184 - protein, 146 aa, Proteus mirabilis
KHDGCIATRIKSMSLFSIFDISGSALSAQSQRLNVSASNMANVDSVVGPDGEPYRAKQVVFQVNAPAGQDIGGVHVTQVVDDPTPFRMEYQPGNPFADEKGYVRKPNVDVVGEMINTISASRSYQANVEVMNTAKSLMQKTLMIGQ

SEQ ID NO: 8185 - protein, 105 aa, Proteus mirabilis
KHSGALISSKLIPPKVGSNEAIISTNLSGSVSFTSISNTSMPENFLNNTPLPSITGLPAKAPILPSPKTAVPLEITATKLPFAVKRYAAKGLAAISRQGAATPGE

SEQ ID NO: 8186 - protein, 252 aa, Proteus mirabilis
VYTGGLLMTASSTLARLKRIMPEHIKPKFTTSAELMAWQREQGEIDSMRIANENRVARLNKIMGRSGISPLHQNCSFDNYDVTCEDQQRALCKAKRYAEQFGKSFGGFIFSGNPGTGKNHLASAIGNHIIQKGKSILIATLPDIMMKVRETYQKDAKTTESKLIDDLCDVDLLVLDDVGVQRGNLNEELIIFQVVDRRLANKKPVGVLTNLNYTQLSKVLDERVIDRLRMGNPTTINFTWQSYRRLLSNLIN

SEQ ID NO: 8187 - protein, 64 aa, Proteus mirabilis
WILGELPFFLQSITKAKSNLRYSKNNNKNSGGVKKEKANPREIGFAKEVVPSLTVFILVLYFSK

SEQ ID NO: 8188 - protein, 74 aa, Proteus mirabilis
VNILSIASGCNSGSPLLASITVSSTTKGMGYCCSLSQTTSIILALESIPILALSILTSESTASNCAATKSGDKS

SEQ ID NO: 8189 - protein, 150 aa, Proteus mirabilis
KIIGGDMYKTILVPIDIDEDNLLNKAITLVENIAKREDPYVHFLYVLPKLPQSSYYRLVMNGDQLDQVCLKKSAEKELKKIIARFDLPEDRIETHICIGKPRDGILQIADQVNADLIVVSSHNPEADSYHLGSTAADITRYAKRSVMVAR

SEQ ID NO: 8190 - protein, 356 aa, Proteus mirabilis
HQQGEVMNKITVLCVDDSALMRQIMREIINSHHDMEVVDCAPDPIVARDLIKKFNPQVLTLDVEMPRMDGIDFLEKLMRLRPMPVVMVSSLTAKGSEVTLKALELGAVDFVTKPQLGLREGMLAYSELIAEKIRAAAQARISRHETKTLPSKSLSFTPMISSEKLIAVGASTGGTEAIRHFLEPLPITSPAVLITQHMPAGFTHSFAERLNRLCQISVKEAEDGERVLPGHAYIAPGDYHMELRRNGANYQIHINKDPAVNRHRPSVDVLFNSVAKYAGRNAIGVILTGMGSDGATGLLAMRRAGSYTFAQDEASCVVFGMPRSAVELGAVDEVKSISSMSKAVLMKISTTQSLRI

SEQ ID NO: 8191 - protein, 552 aa, Proteus mirabilis
RGEGMFRFRKLKISTSLYLLLMMFCVMQVISSGISLGIIHLNNNQITRIDLDTAKRDELGLSWVSLVQARNAINRVAIGMKTEQSTDYIQSIESIALSRLETANTHFQNFLTDINQEVIPQEEKEIFNTVKNDYHVLYSALIELHGMLKKGDFQGFLDQPTERYQTAMENSFNTYMNYVQYEVADSIEQGHHFYTIAILMFIGAITMVIVVSIASHRWLSFNIIKPFASLSRYFNDVATGKLNREILVFTDDEIGDIFRRLREMRGELARSIRIVRDNSQAMYSGIQEISKGNTDLSSRTEQQAASLEETAASMEQLTATVKQNADNALQASKLAESASETALRGGEITHSVVEMMDAITQSSQKIGAIISVIDGIAFQTNILALNAAVEAARAGEQGRGFSVVAGEVRNLAQRSAEAAKEIKTLIDESVSRVSQGSRLVNDAGQTMEELVTSVNKVTELMAEIASASDEQSRGIHQVADAVSQMDQVTQQNAALVEQSASAATALEDQANNLVNAVSAFELPDTDEDGSSHSLEGNGLKKADKKSFFKKTH

SEQ ID NO: 8192 - protein, 464 aa, Proteus mirabilis
QKRGKCMKLRSKLFLVIFATCMIVVFAMHIGIRSSFQQGFIGYIKKNSEQRATLLAEALSDQYQLTGDWRFLNRDDRSIYQILRTIDQISQSGEGPAPRGWRTQFWIVDKQMKRLFGHDNQFPAETFKKPITYHDEIVGWVIVSAADKISNEADISFDKQQLRTSWIIAGLTVLFALLITLILSRSMIRPVKRLVEATHKLAAGDFAVRVTPTNKDEISQLATDFNQLASTLEKNEQIRRDYMADISHELRTPLAILKGELEALQDGVRKPTAETLNSLLFEVTNLTKLVNDLHQLSLSDRGSLTYRKDFIDINEIILLAVASYRHIYQAKEIALQTDLDDNVKLIVQADPDRLIQLFHNLLENSVRYTNSGGQLHISSKREHNNVLIVWEDSAPGLDKAQYEAVFQRFYRAESSRNRSSGGSGLGLAICENIVEAHNGKITAMPSAIGGVKILIVLPVYSEDN

SEQ ID NO: 8193 - protein, 333 aa, Proteus mirabilis
KIVGFKMDNNSLKNASLFDNDPVLYAAWLYYQDGLSQSEVANIMSVSRVTVVKYLHLAREKGFVNISLDSSVFSTIDYSIRIKAKFNLNNVLILPDEEKNKSQQTSNMNRERLAKAGAMYLSQIISNDDILGVAWGRTIHKLGHYLPTKTLENVTVLQMIGAVAPQPDFTTAESAALIANKFSGCSINLHVPAVVSNARLAMELQAEPIIRRNFSALNQCNKALFVVGNTQDDNPLITTGVLTTNEMAQYRDLGAVGVICGRFYDAQGNPLLSDIDLRIMGISLAQLRQIPQRIFIAGGVENVAATIGAIKGGYATDIVIDEVTALALLELSI

SEQ ID NO: 8194 - protein, 68 aa, Proteus mirabilis
GGFMHWITDYWWVILILLVGIIINAIKDMNKIDPKQFLKNKRKLPPHRDFNDKWDDEDDWPNKNDQKK

SEQ ID NO: 8195 - protein, 460 aa, Proteus mirabilis
VVIMTSQSHSTQPLSQPTARPLNRNDYKTLGLSSLGGTLEFYDFVIFVFFTKTLSHLFFPGDNAFIAQMQTLGIFAAGYLARPLGGIIMAHYGDIIGRKRMFTLSIFLMAVPTLVIGLLPTYASIGVAAPLLLLLMRIMQGAAIGGEMPGAWVFIAEHTPKQRYGLGVGTLTSGITGGILLGSIVAIIVQRSYSAQEVNDFAWRIPFILGGIFGLISVYLRRFLQETPIFKEMAAKKALAQEMPVVSVIKNHKQACLITAALTWSLSTAIVVTILMTPSVIVEGIYKIDRTTSLEANCVATLTLTLGCIFWGWLGDKLGTRASMTLSWGGLIVTAFHFYGSLDANMSGIQLAFNYGLMGFFVGAIATTPIVSTRAFPPSIRFSGLSFAYNMAYAVFGGLTPMLTGAWLEKTAMAGAYYVAAVSALAIVIAFLPLAYKGWIAVNTSSREKEIALQVDKVAS

SEQ ID NO: 8196 - protein, 275 aa, Proteus mirabilis
LKIMLTITALLENKTSAPTLSHYPGLSLLLEDTESESKILFDTGKDLTFINNAKKMAIDLTSLTTIVISHGHYDHFGGLTHLNEDFFITKPHIIAHPDLFSVRYSALFMGRQSIKFKRLTPFFNRQQLEQQFSFQLTATPKAIDKRFIYSGQVTERQIHKRYGVIVSESSETDDYVLDDSFLIWQGQQGLVIITGCSHSGIDAIIRHAKKITGNDKIQAIVGGLHLRCASLAALKRAKKAIGHHVEVYGCHCTGALGRSYLNAKDFNTGQRLFFK

SEQ ID NO: 8197 - protein, 169 aa, Proteus mirabilis
NKIMAAEHFEKLSGETVGQGFLIFTLGNEEYGIDILKVQEIRGYDQVTRIANAPSFIKGVTNLRGVIVPIVDLRIKFSQENVTYNDNTVVIVVNLLNRIVGIVVDGVSDVLTLKPEQICPAPEFAVTMSTEYLTGLGTLDERMLILVDIEKLLNSEEMELVDSATIMAK

SEQ ID NO: 8198 - protein, 164 aa, Proteus mirabilis
IFVIICCCFKKHFCQCEVFMSNNEKKVHISSDNNHIDLSNLNEMQHYVTQQRGTEPPFSGKLLHNRETGIYHCLCCSAPLFYSETKFDAGCGWPSFYQPVSDDAILYLDDFSHNMKRTEIRCHQCGAHLGHVFNDGPAPTGQRYCVNSASLAFSNTETGEVQKG

SEQ ID NO: 8199 - protein, 367 aa, Proteus mirabilis
RTSIFMLDLLVQWYKRRFADPQVIALVVILIAGFSIIYFFSGILAPLLVAIVLAYLLEWPTHLLEKLGCARIWAVSIVLTLFIGISAIVILILAPTVWQQAMTLISDIPNMINKFNAFARELPERFPALMDVGIVDMMAENLRSKFSTVAESVLKVSLASLIGVITLSIYLILVPLMTFFLLKDKQQMLNAVRRVLPKNRILAAQVWIEVNQQITNYIRGKVTEMVIVGVFTYFVFAFFDLRYSVLLAVLVGVSVLVPYVGAVLATIPVIVIALSQWGLGSDFWALFIAYLVVQGLDSNLLVPILFSEAVNMHPLVIILSVIIFGGMWGFWGVFFAIPLATLIKAVLHALPDEIANEPPLETLEKKK

SEQ ID NO: 8200 - protein, 304 aa, Proteus mirabilis
SKPILKISKYNYKVNMFFSISKWFLLLVSLITVCACSTVEKNTVPSTTPAIITSANIIDTRTGKTITANALLTQLASQSRVIVGEKHDNQYHHEIEYWLMTQLPNKRPQGAVLLEMLTPDQQNLVDNTKKRYSSSQYLRDERLMSVLNWNKGWSWKGYGNLIKEGLQADYPLLAANIDRSDITNAYKNPPNIEGEYSTQPAVRQLISKTIELSHGGALDKTQIEKMTVIQQLRDRAMAKSLLNAPMPALLIAGSFHATKLMGVPLHIKDLAPNETVTVLIMAEEGSDITYEHADYLWITPAAHP

SEQ ID NO: 8201 - protein, 557 aa, Proteus mirabilis
GVTMSTPLKEQLLQQLNQLETERSSFEPHWCELSDFTRPRSTRFTASDVNRGDRRNSKIIDPTASLASSVLSSGMMSGITSPARPWFRLATPDPDLMDYGPVKLWLETTEQRMNEVFNRSNLYQSLPLMYGDLGTFGTAAMAVVEDSQRIIRTVHFPLGSYYIANSPSLSVDVCYRKFTMTVRQLVMEFGLDSVSDTVKSMWNSSQYSQWVEVVHAVYPNLERQTGKLEAKHKPFKSVYLEVAGDNEKVLRESGYDEFPIMAPRWEVNGEDVYGSSCPGMFALGGTKALQLMQKRKAQMIDKLTNPPLQVPASLKNQRVNTIPGGINYLDEVNPTNKIQTIFDVQPVALKALLEDVQDTRQLIDTAYFVDLFRMMQMVNTRSMPIEAVVEMREEKLLQLGPVLQRLDSELLDKLINRTFSILVNKNLLPVAPDEMQGMDLKVEYISVMAQAQKAIGVGSIERFAGFVGNLAKVKPEALDKLNADDAIDNYASAIGVSPTIVATNEQVQAIRQQRQAQQQQMAQMQMAQSAIDGAKTLSDTNLDNDSALSAMAGGGAQ

SEQ ID NO: 8202 - protein, 491 aa, Proteus mirabilis
DIAMLRIKKEALTFDDVLLVPAHSTVLPNTADLSTQLTETIRLNVPMLSAAMDTVTEASLAIALAQEGGIGFIHKNMPIERQAEEVRRVKKHESGVVTDPITVTPETSLREVQAMTERNGFAGYPVVTKDNELVGIITGRDVRFVTDLDQPVTAVMTPKERLVTVKEGEARDVVMQKMHEKRVEKALVVDDHFHLKGMITVKDFKKAERKPNACKDEHGRLRVGAAVGAGAGNEERIAALVAAGVDVLLIDSSHGHSEGVLQRIRETRALYPNLPIIGGNVATAEGALALADAGVSAVKVGIGPGSICTTRIVTGVGVPQITAIADAVEALKDRNIPVIADGGIRFSGDIAKALAAGAACVMVGSMFAGTEESPGEIELFQGRSYKSYRGMGSLGAMSKGSSDRYFQTDNAADKLVPEGIEGRVAYKGLLKNIVHQQMGGLRSCMGLTGCATIKELNTKAEFVRISGAGIQESHVHDVTITKESPNYRLGM

SEQ ID NO: 8203 - protein, 88 aa, Proteus mirabilis
GYAMFTSQLMLVGYVLLVSPCGHDSCDAVPVTETIYTKDECTIRLNYLKKKRPDLYIFCGEVLRDPEVTDENPYLTPPNSADDVFQLK

SEQ ID NO: 8204 - protein, 463 aa, Proteus mirabilis
IINIFSLRQVVLVMLSTKDMLVLGMMVFALFLGAGNIIFPPMAGFQSGNQWFSTSLGFLVTGVLLPFLTLVTVAIRGRGERLSIDLPSWFAVLFWIALYLIVGSTFAMPRVTNTAYEMGFLPLGLIEKNTTTHLTFALIFNLLSMFFMLKQGTMISAIGKFMTPALLILLVVVGIAVVAKPLSPIEEPTGLYAVNGFFSGIIDGYQTMDVLSAMAFGGIVARALYTKGITNPKQIGFITIKAGMISVLLLAALYLCLFYLGATSHAVSVFADPALNATNGGQIFSRYVDALFGSVGTWLMGGIVLLASMTTLVGVTSAAADYFATFHHRLGYRFWVVVFTLLTTLVSTFGLDTLLRVTIPALLMIYPTSVTLVLLQFVRHKLKSPRFTYRFTICVIVLMSLLDTLKQLKWLNGDLLQLFSYIPLSEYGLGWLLPGIIAFAISLLISLSFKETDTEIATPNTVK

SEQ ID NO: 8205 - protein, 68 aa, Proteus mirabilis
GINMPDIADDANDLTALQINTALANREPPAKSLTGFCIWCREEPVTENSAYCSKECGDDHAQYKRKNG

SEQ ID NO: 8206 - protein, 72 aa, Proteus mirabilis
PKDITMKKLFDTTDFNNCDVCGDDMCTIATEGDGKKVFNGDSVTCCGCSNTGQITVEAEDCAYIEWDNPNDD

SEQ ID NO: 8207 - protein, 267 aa, Proteus mirabilis
IVGISASMNEPTDNTIIGEAPSSYHTKKGGSDDIKGNFLTLLITQMQNQDPTNPMQNNELTSQLAQISTVEGIETLNKTVNTIVGQIDQSQALRATSLVNHMVMIAGNEISVDKINNGENAGSDADTDKDTDTTPDTKLGKLRASTDATDNENIFSSAFGFESFSPIDTLTVNITDSSGAKVRTIEMNSKILPDVYHFFWDCTDDDGNKVPTGKYQFTVNATFNDAQVPVKTLKSAIVNSVSMKEGKPHLDVGLGVIVSLDEIRKVF

SEQ ID NO: 8208 - protein, 175 aa, Proteus mirabilis
SFFIRAQWGSLMNKTVIALIALAVSFTAGFVAGGIYFDNRAMNKQIAGNQLDEKDVATNIVLRKQADNEQQNRLEIYHDAQQHDTIRTDALLDRVLNHFDRVQLSTGTSKTEVASTDNANTCRVEKAKASELSRQLRETLERYGREAQRADENTRTLNLCISELGAKEKLLNSYR

SEQ ID NO: 8209 - protein, 233 aa, Proteus mirabilis
ESLMSIAKRTKDKRIALGLTQSELATLAGTTQQSIEQLESGKTKRPRFLPELAKALNCELSWLLEGDNKQTHASEIPPQDEWHSVSEWDNDTPLNADEVEIRYFKSIELAAGDGCCTNEDHNGYKLRFSKSTLRRYGASPQNVICFSVYGDSMSPVIPNGSTVTVDTGNTRIVDGGIYAIEQDSLFRIKLLYRQPGGKLIIRSYNKDEFPDEFAEIDSVKIMGRVIHWSVMAW

SEQ ID NO: 8210 - protein, 260 aa, Proteus mirabilis
RQLIMHQCVSYFNALKRWPLFASVLILSLLPSHAFAQFPSVISHPLPGGGQSWSLPVQTLIFITALGFIPAVLLMMTSFTRIIIVLGLLRNALGTPSAPPNQVVLGLALFMTFFIMAPVFDKIYQDAYLPFSEDKITFEQALDNGSQPLRQFMMQQTRETDLALFARLADAPAFETRDSVPMRILVPAYITSELKTAFQIGFMIFIPFLIIDLVVASVLMALGMMMVPPATVSLPFKLMLFVLVDGWQLILGSLAQSFFN

SEQ ID NO: 8211 - protein, 82 aa, Proteus mirabilis
AIAIMGTTSSATRAIQRRPPKIIKPLITTSPIPTYNGSKLNADAAACAIELACTALKTSPKAMMRKMANNTPIQRILRPFVI

SEQ ID NO: 8212 - protein, 246 aa, Proteus mirabilis
TYHIFGVCQMQKKAELYRGKAKTVYTTESSDYLILEFRNDTSALDGQRIEQFDRKGMVNNKFNYFIMNKLEEAGIPTQMERLLSDNEVLVKKLDMVPVECVIRNRAAGSLVKRLGIEEGTVLNPPIFDLFLKDDARHDPMVNESYCETFGWVSKENLAEMKRLSYKANDVLSELFDKAGLILVDFKLEFGLFNGKVVLGDEFSPDGSRLWDKNTLDKMDKDRFRQSLGGLIEAYEEVARRIGVSLD

SEQ ID NO: 8213 - protein, 256 aa, Proteus mirabilis
ISHMDVSMISLLNKETTMSDEKESQFISKLVIYLFIFILIVYHIWEAEPGTSEKLANIFSFISSLGILATIGVYFAQKRNNNKIENERLNNKGIAVKKTFRLELEASILIYEEIFNLINFIKNEPYTSVKISENKELVTFYVHNGKILVGQFHMEKHSTNVMKDLLLLSVDVDDNLYQQLLFCYNSIVTSNWFLNTFILFHKTMMDIMKIKQRNIILTVKTMNYIIFNTEIHNNKYSELLIRELKTLKEIHNAYYL

SEQ ID NO: 8214 - protein, 83 aa, Proteus mirabilis
SANITPNSKSYGQLNLTHRDAIRGMNMSKQMHLQAATNAVGSECSTELDITEDEWNKLSLEQQNQLIGEFMGNVCEWWVQPED

SEQ ID NO: 8215 - protein, 210 aa, Proteus mirabilis
EISMLTIHSLTTGILTEVSLHLEQGCCLGISGSSGSGKTTLLNAIAGYTDYTGDIVLANQNMNKLPVWQRPCRYLNQRLYLFPFLTVKQNLWLAQYAAKQKRSKEKEIALLEQMGIAHLATRYPSQISGGEQQRVALARALISQPKLLLMDEPFSSLDWETRYQLWELIISLKKQQITMIIVTHEPRELQALADKTLLLSNGKIVQESKN

SEQ ID NO: 8216 - protein, 401 aa, Proteus mirabilis
GYSMLTDTKLRSLKPQDKLYKVSDRDGLYVAVTKSGVISFRYDYRFNGRRETVTFGRYSADGITLAEARAELTEAKRLLNAGISPASKKRDGIESKKIGTVFKDYTVNFLNDAQYADSTRAMKEAIIEKEIYPVFGKLQLEEITTPRLRALCEKIKDRGAKATALQVREIVGSVFTYAIDRGYEISNPADAIKASSIGTFQARERAMSPKEIGILFRELENYSCYPTLKLAVKFVLLTLVRKSEFIHATWDEIDFKNRQWVIPKGRMKGRKEHVIYLSDQAMDILTGMKVCAMGSDYLMPGRYDIKKPLSNAALNNVIDGTVKRINEKGIEFEPVTVHDLRRTASTLLHEAGYNSDWIEKCLAHVQNGVRAVYNKAEYAEQRRKMLQEWADMVDEWIKEKD

SEQ ID NO: 8217 - protein, 202 aa, Proteus mirabilis
MKSIAEIRKDNLIYIIERYYNGKQKLLADALGVAPSMISRYLSPKDLKSHRELTDPMSRKIEYVTRISKYWMDVDHLKEGHAESEKEEYIPTEIGKILSDNITTFMLNDGIKSRVKLSVDSGLAQSTVNRIINCEASATAESIDAIAKAMGRQAYELLIPKNDKGTINYDRRAYSKLPASEQAAIENFIEFIINKNQPISHD

SEQ ID NO: 8218 - protein, 351 aa, Proteus mirabilis
GILMATLLHKSKIMKVAGLSLVVLLAACSSDQRYKRQVSGDESYLESAALKNLVVPAGMVLPLQNGEYDIPTPKKSEPVGLALDIRPPTQALNLLSGSRSENNADNSRLLLPNTPENTTLYEQVSAVLADKGVALAKSDAGQKQIVTDWITWTRADENVPFQSRHNLAISQSGNVVILTITNTGLRQGENEISDPMEVKRYNTLLLNEVVDGLNRMRNLSENSATSNLQGIIDVQTGSDNAGLPVIIVRAPFDVVWDRLPIALESVGMKMGDRTRSKGSIEVTYKGLSSASWSTLGVDKPTINEGDYKLQVGDLNNRSSLQFISDKGKPLTQSENDQMVAAMKAAFSKPIK

SEQ ID NO: 8219 - protein, 472 aa, Proteus mirabilis
VFVLKFDLAHMTLPINNNIFTVSRLNKTVRQLLEMEMGRIWISAEISNFTQPASGHWYFTLKDTHAQIRAAMFRGQNTKVTFRPQHGQQVLVRATITLYEPRGDYQLIVESMQPAGDGLLQQQFELLKQKLSAEGLFDALHKKPLPTPAKQIGVITSSTGAALHDILNILRRRDPSLPIIIYPTAVQGAEAPMQIVHAIELANRRKECDVLIVGRGGGSLEDLWAFNDERVARAIFASDIPIVSAVGHETDVTIADFIADLRAPTPSAAAELISRNKLELLRQLQSQQQRLEMAMDYYLAKKLRALTQLHHRLQQQHPHLRLARQQNVLATTKQRLVTSFQRLLQTKQNQHTQLQKRLNYQEPSPQIQALLRQQQQLIYRMRESISQQLARQREQFAISCSRLESVNPLATLSRGYSISEVASGDVLKNTKQVKKGDTLKTRVEDGWITSEVINTQKISVKRKPAPKRKSSI

SEQ ID NO: 8220 - protein, 324 aa, Proteus mirabilis
LKIIFISHGFLSVNMCFIYINKINLIVLFNTAKEWWIMFFSRKLEAFMAVVENGSLSKAARVMNRTTPPVAKSIKDFEAVLGKRLFKREKFGMSLTQEGLELYNDLKSLYLQEKEITKKHTSGVINNSIHVYYDWGKSQYLTALYQAANKNCSHINMMRFSKDNFEEIPDYDGNTLILSSDKIISEKFSLIHQVKNKYLGICCQQILAQKAQENINTLLKENIWLCDPALYKTAKIKKLENEIADQGKPVSIRLMDDLNCCLNFIQTHHSLLFTDENPIKSEDEKQLCFIPLTQTELIYNCYIYKSKYHSSILNRFVDLIKELE

SEQ ID NO: 8221 - protein, 123 aa, Proteus mirabilis
LLVIKFFIHYLYNCFLFLFLKFFKIISFSYLHYSSLSFTLLSYNKGESTMGYNLAELTQEEKDKINVNLAASGVAFKERYNMPVVADAIAREQPQALQSYFQERVTFYRARSQHYSRLPFESK

SEQ ID NO: 8222 - protein, 221 aa, Proteus mirabilis
GVAMSGDPIMPKDNVEITSDIISRIGQLTRMLRDSLRELGLDKAIAEAAEAIPDARERLDYVAQMTAQAAERTLNCVEAAQPKQDELSSHATKLTERWDQWFEHPEDLKDVRSLVTDTRNYLRDIPESAAFTNSQLLEIMMAQDFQDLTGQVIKRMMSVVQEIEKQLVMVLMENLPPEQLEKSNAKKETDSLLNGPQVNKNNAGVIKNQDQVDDLLESLGF

SEQ ID NO: 8223 - protein, 526 aa, Proteus mirabilis
APKISIRRIKNIMDMSIRQALLKNFMGNSPDWYKLAIITFLIINPLIFFFVDPFIAGWLLVVEFIFTLAMALKCYPLQPGGLLAIEAVIIGMTTPKQIGHEIANNLEVILLLVFMVAGIYFMKQLLLFAFTKLLLSIRSKRLLSLAFCFASAFLSAFLDALTVIAVVISVSLGFYSIYHNFASNQADAELSNDGFIDSTEKKQTLEQFRAFLRSLMMHAGVGTALGGVMTMVGEPQNLIIAKHLEWDFVTFFIRMSPVTIPVFFAGLAVCYLVERFKLFGYGAELPELVRKVLTDYDKKNSEKRTQQEKAQLLIQALIGIWLIVALALHLAEVGIIGLSVIILATTFCGITEEHALGKAFEEALPFTALLTVFFSVVAVIIDQQLFGPIIQFVLQASESSQLSLFYLFNGLLSAISDNVFVGTVYISEALSALQEGLISQSQYEHIGVAINTGTNLPSVATPNGQAAFLFLLTSALSPLIRLSYGRMVIMALPYTIVMTLLGLLAVEFWLVPMTHWLYEIGLIAIP

SEQ ID NO: 8224 - protein, 298 aa, Proteus mirabilis
GYKIMNEKIFSLPVIEQISPYLSRRQLGELPILVISHPKVRAAISLQGAHLIAWQPAQTHPVLWLSEDALFTPGVAIRGGIPICWPWFASAGTPSHGFARILPWEFSAHSEQEDGVLITMTLKESAQTQKYWPHEFTVIARFKLGDTCEIELESYGDYEATAALHSYFNVSDIDKVSITGLGGHYIDTVADKEVYTDETALRFNGRTDRLYTEPEDFNLIHDDGWDRTIEVHHYHHSDVVCWNPGAELASSMKDMSSGGYRKMACVETARIHRPLKPDNVHPGRLSAVIRVRKNIAEK

SEQ ID NO: 8225 - protein, 577 aa, Proteus mirabilis
VNKMSDTKHLNVLIAKALLLNQDITDSEQVDALTAHINGDIEKEEFKQYDHFINITLLALSLVPNISSELSEEQIVNAIMSFIDNPDMRSVRHRVNHFNSLTNPKTTSNEVEKKEAPQEEVIFHANKDNQNGQHEEAEDNPKEENDQPAYFEPGRYPDIPNEVYHSSNGISSSMLKDARISLMYYELRHVTKVIERENKRCFDLGSAFHTLTMEPEKFDAEFSVKPIIPEGAFTTTETMKSWIDEYNNKLPKKLSQDELKAIIEEHNATLTPQLSTSGKAEELGQIYMQLPDEFKTIPEDGKFTGAAMKACIKAYNDTLPTPLKTSGNTDALLDQIYFHINPELYLAETHKPEPLRKPVKKDDLMQVIKEVNPDAVFEDEIISQWLSDDSKIHVQTVDYEMANNMRNAVMNHKEASSLLNHPNRVSEVSYYGIDEDTGLEIRVRPDIEIQTENNRLGFDLKSVALGRFKQDAIEAMIRREIINRDYHISAAMYCDVAMLDQFFWIFVNKDEHYHWVAIVEASPELLELGRTEYKKTLRDIREAMDTGYWPAPITTTLTIGITDFEQRKLEELQNEVA

SEQ ID NO: 8226 - protein, 156 aa, Proteus mirabilis
SGKIKRVPMREQSPLVTLRELAQTAAEQAAVQLAQVRQSHQQMEQQLNMLIGYQDEYRVRLNQTLNVGGMSSASWQNYQQFLKTLELTIEQHKQQLRHWQAQLDLATEHWREKQQRLNAFETLEQRAEDSRKRQLDRIEQKQMDEYAQRSTLRRTT

SEQ ID NO: 8227 - protein, 119 aa, Proteus mirabilis
MMKIKTSKLKGLALDWAVGKAIGVDVRIGKEFIVDANNCVYSPSSDWLKCGKFIETYAIELINEMLSNDFGHYQIAWSAICNYLQDDYYDGDTPQEAICRATVAVVLGGEVDVPEELLK

SEQ ID NO: 8228 - protein, 113 aa, Proteus mirabilis
GEEMNGLTYLILAIISEVIATTVLKASDGFSRLYPSIVVVVGYCFSFWALSQVVKVMPLGIAYAIWSGLGIVLVSVAAVFVYQQKLDLPAIVGMTLIIAGVLVINLLSNSTSH

SEQ ID NO: 8229 - protein, 262 aa, Proteus mirabilis
PDRISVRRITKRVSKMDTKVITDNSGASKLSVRWRRHQRLGTALLVLTLAGCAQIPKKPLVEGHTTAIPTAPTTPAPNGSIFQATQPVYFGYQPLFEDRRPRNIGDTLTITLQENVSASKNSSANASRNGKAGFLASITPRFLEGLLGNSRTDMGMEGNSEFGGKGGANANNTFKGTITVTVDQLLANGNLHVVGEKQIAINQGTEFIRFSGVVNPRTISGSNTVNSTQVADARIEYIGDGYINEAQSMGWLQRFFLNVSPF

SEQ ID NO: 8230 - protein, 145 aa, Proteus mirabilis
MITLGYKAMRKSSEELLKCIATILQWVLNCGLLILAIVLVSFLIKETYVIASLLFNLAAEESSYQLLEGILIYFLYFEFIALIVKYFLSGGHFPLRYFIYIGITAIVRLIIVEHKDSVDTLIQSGAILLLVIALFIANTEKLKRS

SEQ ID NO: 8231 - protein, 89 aa, Proteus mirabilis
KLLIIITLTSVINRYGNFMINNVNGDDMEYWFIAYKVRSRNGDTYAGHKIVETESGITPHIALEKACQEVAQGAQADIPAVRVVAFNRL

SEQ ID NO: 8232 - protein, 103 aa, Proteus mirabilis
IPVILFKAERYSSARSLNMNIKLPINPIRMPDVLKLTGLSRSTIRTLEKKGDFPKRMYLSVRCVAWEAEEVDEWLKKRSQSRETPKCYTERKRNEAGQFVSNA

SEQ ID NO: 8233 - protein, 373 aa, Proteus mirabilis
GETMSRPAKISINLDALSHNLSVIKSKAQGSKVWSVVKADAYGHGLSCVWPALSHTDGFALIELDKAIMLREQGWVGPILLLEGFFKPDDVYLLERYSLTTVVHADWQFEAIEQAQLERPINIYLKLNSGMNRLGYRPEDYQQAIQRAKRITNIGSIVQMSHFANADTGLNMATQKQIIDSSMVNDLPRCLANSAAILFEPQTHHSWVRPGIILYGVSPTGVWQDIADFDLQPVMTFNSEVLAIQSVKKGEQIGYGSRYTAQRDMRIAVVACGYADGYPRHAPDGTPVIVKGHKTQLVGRISMDMLTIDVTDLPDVEHGSPVELWGNQLPVDEVALACGTIGYELLCAIAPRVAVEVTINVANSTFSDLNESC

SEQ ID NO: 8234 - protein, 85 aa, Proteus mirabilis
LHQMSVDIAGGVMNSISISAVLLAAIVLFASVFVVALASSLLLKKTLYGSLQQDNLSVSVAVRRTFMVSLVVALLLVYYFLSTTT

SEQ ID NO: 8235 - protein, 289 aa, Proteus mirabilis
LGEICYYLSQFYFGICKNIMSYQCPLCSQPLALKAHSWVCDNHHQFDCAKEGYVNLLPVQFKRSKEPGDSAEMISARRDFLDAGFYQPMRDKVAQLVAEHLPEDNPQVLDIGCGEGYYTYQIYQQLKSKNPQVYGLDVAKVAIKYAAKRYAPIQFCVASSQRLPFCDASLNAVVRIYAPCNASELTRVIAQDGYIITVTPAPRHLYQLKALIYSTVHLHPLKDEIFAGFKLIAQHQVAYNMALTGKQAVDLLQMTPFAWRASEEVKETLDKTEQFACETDFLIRVYQRV

SEQ ID NO: 8236 - protein, 144 aa, Proteus mirabilis
TLWMRNKPMSDENRPTDNSQSAEDMWADAMEQQTGKSQDNSSDVFEHLLPEDDTLNHLSDINLIMDIPVKLTVELGRTKMTIKKLLSLSQGSVVSLDGLAGEPLDILINGYLIAQGEVVVVSDKYGIRITDIITPSERMRRLSR

SEQ ID NO: 8237 - protein, 277 aa, Proteus mirabilis
LLYFNMGMIMSIKLIVIDLDGTLLNEQHEITPEVHQAIQHAKNSGVHIVLASGRSFNGISPYLKALNLDTSDNFCISNNGSQIHQAENGEIITEDLLNFEDYLYFEDLSREIGVHFHVLSDNKIYTTNRHISHFTCREAFLTWTPLYYRPLSEMQRDMRFSKFMIVGTPTVLDNAMQYLPANIYQQYSILRSAPYFIEILNTDVNKGNAVQKIAEHLKITPEKIMCIGDQDNDLAMLQYAGLGVAMGNAPEEIKKVAKFITLSNKEHGVAVAINKFI

SEQ ID NO: 8238 - protein, 386 aa, Proteus mirabilis
LPDFYRSLIFMSCPVIELAQQLISRPSVSPDDQGCQQLIIERLAPLGFTIEKMPFGQTENLWACRGGEGETLAFAGHTDVVPPGANALWDNPPFEPSIRDGMLYGRGAADMKGSLAAMVVAAERFVHAYPQHRGRLAFLITSDEEADAHDGTVKVVESLISRGERLDYCLVGEPSSQHQLGDMIKNGRRGSITANVTIYGTQGHVAYPHLAQNPIHMASPFIHELVNTVWDNGNEYFPATTMQIANINSGTGSNNVIPGELFIQFNFRFSTAITDEEIRQRTEALLQKYQLRYHISWSLSGQPFITGEGKLLDAVRYSVKHYTNIEPTLSTSGGTSDGRFIAQMGAQVVELGPINATIHKVNECVSAADLQQLSRIYQRIMEQIIL

SEQ ID NO: 8239 - protein, 132 aa, Proteus mirabilis
NGTVMPQDNHLALVCALSKWIEEHLGRVIHLEELAAYSGYSLWHMQKIFKEVTGTSLGKYIRQRRLAGAIHLLRTSDRSIFDIALDFGFGSQSHFTYMFRKEYGITPFDFRQNQNIELETKQPLHLQSLCCD

SEQ ID NO: 8240 - protein, 283 aa, Proteus mirabilis
HFAVFFLLRSCLNFSYLSLYKKLYNDIVFEDVMKRQILVGLGFALGLFCHNSFAVELHLYAGAGLKQPVEQVVGLFEKETGNTVTIEYGGSGQILTRFNLTQQGDLFFPGSQEYVEKLAKQNQVVSQYPIVRHIPVIAVRKDKIGEIKTITDLANSSLKLGMGDAKAIALGKSGEQLIEASGQGEQLRNKVVVRTATIKQLLMYLLNGEVDAAIIGYADAMKNQDKLVLLPIPEGSPEEIATLAVLKTSTNPTQAQQLADYFSRPEGIKAFTDYGFLPVISKP

SEQ ID NO: 8241 - protein, 290 aa, Proteus mirabilis
SSYVAIVSPSHHHNWQHIKFKSCKEIPSNIIMHNQILKKLPQIEQTHQIKLLYVAESGSRAWGFASTDSDYDVRGIFIRPRNAYLSIDKPKETFEWIENNWFDVGAWDITKALHLLRKSNAILFEWLQSPIVYQQYAGIQKELFELAQLYYQPQIIVHHYRGIAKAVSRHHFEESHASKAIDEPIKLKKYFYLLRSLLAAYWTVKTENIPPMELNQLINILTTDEQIIIRELVSFKADKDEHFTWLPTDNMQKLITFLWQETATQLAKRTVPDSEILNNWFRKILDETDH

SEQ ID NO: 8242 - protein, 297 aa, Proteus mirabilis
HWHVTDLHLFHYPVSISYPIIQSINGYSHMKFVSFNINGLRARPHQLEAIVEKHQPDVIGLQETKVHDDMFPLETVSALGYHVFYHGQKGHYGVALLTKAKPVAVRKGFPGDGEEAQRRMIMADIETPAGLLTVMNGYFPQGESRDHETKFPAKAKFYADLQQYLTTSLTPSSPVLIMGDLNISPTDKDIGIGENNMKRWLKMGKCSFLPEEREWLATLMGWGLTDTYRAQHPEVEDQFSWFDYRSKGFDDNRGLRIDLLLASRCLADNCISTGIDYDIRAMEKPSDHAPVWAEFKL

SEQ ID NO: 8243 - protein, 64 aa, Proteus mirabilis
QFNVDYFLINKKINIHVNLLINHLVNFIYNTFFPGVVLFFALFPQQGFFLSLFFILLVITQSFL

SEQ ID NO: 8244 - protein, 150 aa, Proteus mirabilis
MSNVDPSLLILLVLAGLGIISHNMTVTLAMIFLLVIKITPLNQYFPLVEKYGMTIGILILTVGVMTPIATGRISAQEVFNSFLNWKSLLAIAIGIIVSWLGARGVSLMNNQPSTVAGLLVGTVIGVALFRGVPVGPLIAAGILSLLIGKS

SEQ ID NO: 8245 - protein, 1031 aa, Proteus mirabilis
WSGVMKLFALFIQRPVATTLLSLAISLCGALGFMLLPVAPLPQVDYPVINIYASLPGASPETMASSVATPLERSLGRIAGIDEMTSSSALGSTSITLVFDLNKDINTAARDVQAALNASQSLLPSGMPSRPRYYKSNPSDAPIMILTLTSETQNTGELYDLASTRLAQKISQIEGVSEVSVGGGSLPAVRVALNPDALFNQNVSLDDVRKAISQSNVRRPQGFIHNDENRWQIQTNDELSKAQDYRPIIVHYNQDAIVRLSDVAQVTDSVQNARAAGMSGGEPAILLVIRREAGANIIETVNRIRDELPELRELLPASVNLKVAQDRTPTIRASLAEVERALAIAVALVILVVFLFLRSGRATLIPAVAVPVSLIGTFSAMYLCGFSLNNLSLMALTVATGFVVDDAIVVLENISRHIENGLKPKQAALKGVSEVGFTVLSMSISLVAVFIPLLLMDGLVGRLFKEFAITLTTAIGISLFVSLTLTPMMCAHLLKGIKPKAQSHLRGFGKLIFRLQQGYSVTLQAALRHKRWIMAIFITTLGLNAYLYISAPKTFFPDQDTGRLMGFVRADQSISFQSMKEKMTRFMQEINADKDVDSVTGFTGGGRINSGFMFISLNPLSERTDSANQVINRLRIKLANEPGATLFLMPVQDVRAGGRQANASYQFTLLADDLSELRKWEPLIRKALGELPELVDVNSDKEDKGAEMALTYDRDTMSQLGINVSDANNLLNNAFGQRQISTIYAPLNQYKVVMEVSEQYTQDVSALDKMYVMNTQGERIPLSAFASWYPANAPLSVNHQGLSAASTIAFNVPEGYTLSDAINAIERTMTELGVPNTVRGTFAGTAQIFQETIKSQLILILAAIVTVYIVLGVLYESYIHPLTILSTLPSAGVGALLALRLFDTPFSLIALIGIMLLIGIVKKNAIIMVDFAITAQREGKLSAQEAIIQASLLRFRPIIMTTLAALFGALPLMLSSGDGAELRQPLGITIVGGLLMSQLLTLYTTPIIYLFFDGVRQRWQQRRHNKKEANA

SEQ ID NO: 8246 - protein, 506 aa, Proteus mirabilis
QLIVTDIWRTAIMALNSPMLITFTIYILGMLFIGYLAYRSTKNFDDYILGGRRLGSVVTALSAGASDMSGWLLMGLPGVVFFAGISESWIAIGLCLGAWLNWRLVAGRLRLQTEKNNNALTLPDYLTSRFDDKSKMLRIISALVILIFFTIYCASGVVAGGMLFESTFGIPYHEAMIYGALATIAYTFLGGFLAVSWTDTVQATLMIFALILTPIIVIFSIGGIDTSIEIIKAKDPTYLDMFKGLDFIAIVSLLAWGLGYFGQPHILARFMAADSNQTIRKARRIGMTWMILCLGGTVAVGFFGIAYFEVNPAVAGPVMAKNERIFMELASLLFNPWIAGILLSAILAAVMSTLSCQLLVCASALTEDLYKPFIRKNASQKELVWVGRGMVLLVAVIAIYLARDPENKVLDLVSNAWAGFGAAFGPVILISVTWKRMTRNGAFAGMLIGALTVLVWMQYKWFGLYEIIPGFIFASIAIVIVSLMGKSPTAENQQRFDEAEAEYRNT

SEQ ID NO: 8247 - protein, 438 aa, Proteus mirabilis
REVVSMTRRAIGVEERPPLLQTIPLSFQHLFAMFGATVLVPILFKVNPATILLFNGIGTLLYLFICKGRIPAYLGSSFAFISPVLLLLPLGYELALGGFIVCGVLFCLVAGIVKIAGRGWINVMFPPAAMGAIVAVIGLELAGTAANMAGLLPSADNPVDSQTLIISMVTLGVTILGSVMFRGFLAIIPILIGVLAGYALSFFMGVVDVTPIKEANWFALPTFYSPRFEWSAIFIILPAALVVIAEHVGHLVVTANIVQRDLMKNPGLHRSMFANGFSTIISGFFGSTPNTTYGENIGVMAITKVYSTWVIGGAAIIAILLSCVGKLAAAIAAVPVPVMGGVSLLLYGVIGASGIRVLLDSKVDYNKPQNLILTAIILIVGVSGASIQIGAAELKGMALATIVGIVLSLVFKLVSIIRPETELVDDTLESINEHTNTK

SEQ ID NO: 8248 - protein, 659 aa, Proteus mirabilis
QTNVMRLFIAEKPSLARAIADVLPKPHKRGDGFIVCGDNQYVTWCVGHLLEQAEPDAYDPRYARWSLDDLPIIPNKWQLKPRADVKKQLDTINTLLKQADEVIHAGDPDREGQLLVDEVLNYLNISDAQRKQARRCLINDLNPAAVSRAIDKLRYNHEFIPLCVSALARARADWLYGINMTRAYTLLGQRNGYQGVLSVGRVQTPVLGLVVRRDEEIENFVPKDFFEVKAHIVTPADERFTAIWQPSEHCEPWQDEEGRLLHRKLAEHVVDRIAGKPANVTDYQDKQESEIAPLPFSLSALQIEAAKRFGLSAQQVLDTCQRLYETHKLITYPRSDSRYLPDEHFAGRHAVMNAISVHDNSLLPQETLDIDKKNRCWDDKKVDAHHAIIPTAKTGNISLSENEKNIYYLIARQYLMQFMPDAVYRKCVIELDIENGKFIAKARFLAQAGWRTLLGSKEQDAENDGSALPIVAKGDELLCEKGEIVAKQTQPPRPFTDATLLSAMTGIARFVQDKELKKILRATDGLGTEATRAGIIELLFKRGFLQKKGRAINSTPAGRALIHVLPDMATLPDMTAHWESILTQISEKQFKYQDFMMPLSNTLFELITQAKRRPNIQAFRNLPAPAQNKKRKGATKKSAQGKSRSAQSQSTNRNIKSDA

SEQ ID NO: 8249 - protein, 349 aa, Proteus mirabilis
GLDVTNKSSLSYKDAGVDIDAGNALVDRIKSVVKETRRPEVMGGLGGFGALCAIPTKYREPILVSGTDGVGTKLRLAMDLNRHDDIGIDLVAMCVNDLIVQGAEPLFFLDYYATGKLDVDTAARVVTGIAEGCKQSGCALVGGETAEMPGMYHGNDYDIAGFCVGVVEKSQIIDGSKVKAGDALIALASSGPHSNGYSLIRKILEVSGACAETTPLGDTSLADKLLAPTRIYVKSLLSLIENVDIHAVAHITGGGFWENIPRVLPENTQARINSQSWQWPEVFNWLQQAGNVSTHEMYRTFNCGVGLLIAVSQADVEKTLSHLNACGEKAWLIGDIAPQAAGDAQVIIN

SEQ ID NO: 8250 - protein, 69 aa, Proteus mirabilis
SKSVYFSPSNKSRLDKAAYIFFNSLRYQPVFWLFFIHKIEHPQRAEIERMPPASQLCPYRPKLTNRLET

SEQ ID NO: 8251 - protein, 491 aa, Proteus mirabilis
RFLVSTANTPEDEQKPSLNAFKQPRAFYLIFSIELWERFGYYGLQGIMAVYLVKMLGMSEAEAITVFAAFTALVYGFVAIGGWLGDKILGTKRVIVLGAIVLAIGYAMVAFSDHDKDMIYWGLATIAVGNGLFKANPSSLLATCYEKDDPQLDGAFTMYYMSINVGSFLSMLATPWLAANYGWDVAFALSVVGMLITLANFMLCRGWIKDKGSRPDFEPLNYLKLLLTLVGIVALTAVSTWLLHNNEVATWSLAIISLGIILIFARETFMMKGVARRKMIVAFLLMVEAVVFFVLYDQMPTSLNFFAIHNVEHAILGFSVEPEQFQSLNPFWIMLASPLLAAIYNFMGDKLPMPYKFTVGMFLSATAFLVLPLGASMANEAGIVSSWWLVASYGFQSIGELMISGLGLAMVAQLVPQRLMGFIMGAWFLTSAAAAIIAGKVASLMAVPEDVQNAHASLEIYSSVFLQIGIVTGVIALLMLFTAPMLSKMTQ

SEQ ID NO: 8252 - protein, 116 aa, Proteus mirabilis
EKIVPIICFLSRKHLTFFMKTMLNLILEITYCEFYNNSDRRCYRIKANAYFVISTINKMYLKDFNLNAKKIIISLIIILAISLGLYLVALDNFCDQGEDFQQGICRFTILFPSKQP

SEQ ID NO: 8253 - protein, 686 aa, Proteus mirabilis
VIVVPSLDLLRYQQAFARLGQRRLLLLAGSYTWQREQLRAIQQQCKGDWLILSSEMSEAIKPEHAHQLLGREYLHAVFDANHAFNADALAMLTGTLKAGSWLILCLPDIVQWQHYIDNDSQRWNDAQGVISTPHFMAWLAKITLADKQAIIWQASQPLVLPEIKNTGQQWALPQGMPTIQQQQLLAHLLQVKSGVWSITAPRGRGKSALAGMLIEQWPGSVTVCAPARNSIEVLLSHTHKTIEFYSPDNLLALCHTERLCRDWLIIDEAATIPIAQLIALCQHFPRVLMTTTVQGYEGTGRGFILKLGDSIPTLQNYQLTVPIRWAQDDPLENWLNQLLLLDEPSFHHANQSGEVVITSCQHFDSEQRANFYQLLTSAHYRTTPLDLRRLFDGQKQHYWSAFIHRHLVGAVWCIEEGGLAKALAQDVWRGIRRPRGNLVAQSLVTYGLSIEAMCLTSLRISRIAVLPAYRRQKVAAKLVADIAKQCQKQNIDYLSVSFGYTDALANFWQQCGFYLVRLGVHKEASSGCYTAMAIYPISAQGQQLLQVAQQALALQSDYITQQTGISLATALPSACEADHWLMMAGFAFAHRSVLTVYQSVGYFLQDERSRYPLLVAFFIDKQSVEACVKQFSLSGKKALVTTLRRQCQQLMAEKDEQLAQAYQHWLTTTSSGHFCWANRPHHPIYH

SEQ ID NO: 8254 - protein, 72 aa, Proteus mirabilis
SRSVQKEKWLMIILLTLLAVYLWLAGYLFSESKHEIDNIKDIVARLFYSTIWPVVGVLYLSSLLAYKTLGEE

SEQ ID NO: 8255 - protein, 347 aa, Proteus mirabilis
FIRVLGLMQKKSIYVVYTGGTIGMQHSDHGYIPVSGHLQRQLAKMPEFHREEMPNFTIKEHLPLIDSSNITPEDWQSIADDISENYCHYDGFVILHGTDTMAFTASALSFMFEGLAKPVIVTGSQIPLEALRSDGQTNLLNALYIAAHHPINEVALFFNNTLYRGNRAIKAHADGFNAFASPNSAPLLEAGINIKTFKINPLPKPKGEFIAHHITPQPIGVVTIYPGLSDEVVKNILMQPVKALILRSYGVGNAPSHPALLSTLREATERGVVVVNLTQCISGRVNMGGYATGQALADVGVISGYDMTFEAALTKLHYLLSQQYSYTEICRLMQQNLRGEMTLNDDD

SEQ ID NO: 8256 - protein, 252 aa, Proteus mirabilis
WFPVFYPKVSFVVSDLYTAEGVMDKNSLWERYVPLVRHEALRLQVKLPASVELDDLLQAGGIGLLNAVERYDSMQGAAFTTYAVQRIRGSMLDELRSRDWAPRSVRRNAREVTQSIHQLEQDLGRPPSEQEVADHLQIELAEYRQILLDTNNSQLFSYDEWHEIYGESCEPSQDEDHDDNPLQMLLESDIRQRVIDAIELLPEREKMVLTLYYQEELNLKEIGAVLNVGESRVSQLHSQAIKRLRARLNPEK

SEQ ID NO: 8257 - protein, 729 aa, Proteus mirabilis
AMTVSTELSHEEYVGNGVTTDFDFRFRIFESRHLIVVVADNDGNETTLKNGTDYTIVGAGSFHGGKVVLNKPLAKGWKILLERDLPVVQETDLRNQGKFFAEVHEDAFDYLTMLIQKALGTFSLSLRKPTYLSNYYDAKGNHIANLAPPKLGTDAANKDYVDNSIKDIDSKTLRVKDKPIPALPSAEQRRNKQLGFDNEGYPQLLDPAETGSLGYVLVDSFEKGAEITTRYQALHFENNGEYYRWDGELPKIVVSGSTPDSSGGTGAGKWISVGDSTLRSQRIFLNKNNKLSLSDYPSVLDFDFIYPNDETKDSTQGFLNALNDDSITDIWVPKGLYRVDEKIVTQAGKRIRFAKGARLIRLSKYSDNTDPVFILRGSYSESYGGEFITENDHPHGVVRLGHQDSNDNKNALWWRFENPFIKGVQREGNIGIDITNAQVNIGTSSANYFGYVSNPIIHGSDEGIVLNEIANAHTIISPQLYRCVTSGISYYGAYANHVIGGFLHQSQNGVIGINLRNKRIESAHHSSNNQVDGFGIEPGGSLSKAIYIDSECTRNRINVMGNVAGGVVILNKKNDYNTLFANSTNEQNVNNLHIKDKVRSINTQTEFNKKTNITENTSIDFFKITLPSNGSGYLINCNLTARNPSIDNVYPAMAVISAMNRSQLKAAYVREEKPTGRCGEVYYRVDGNVLIIGGKSYNNGTSTVFINFSMSITIESSEDGMSGVMVSKM

SEQ ID NO: 8258 - protein, 254 aa, Proteus mirabilis
LRAVKLFFMEETIPMSDKNTDTNWKPWVPKELIDWELKVKEDTGLDEKEDENQEKEVVQQQKVLEQINMLDDMKEKAQKLGHAEGFEAGKNQGYQEGYQAGLQSGIEEGIRQGIAKQEPFINEWQGLLAEFRHSLNGLDSVIASRLMQIALTAAKEVLGQPAVCDGSALLAQITLMLQQEQMFAGDPQLRINPKHIPLIEKELGDSLTAHGWKVVADNSIHVGGCRVVTNDGDLDSTIATRWHELCRLAAPEAL

SEQ ID NO: 8259 - protein, 66 aa, Proteus mirabilis
SNEVEMEIISRKEAASKGLGKFFTGKKCKNGHVAERYVCNGVCVKCNFENSTVYRSVLKQLINSAK

SEQ ID NO: 8260 - protein, 298 aa, Proteus mirabilis
WGRVMRWNDRRRSNNVEDRRGQPSSASGGGNLPLGLIALLLRTKYGFVIIIILVIASFMGFDFNSLTGQTSQPTQNSQQQSALYNEAADFSSVVLASTEDFWQGMFAKAGEQYRDPKLVLYTNSTTTQCGTGTKMMGPFYCPADQKIYLDLSFYNEMKNSLGGGGEFAQGYVISHEVGHHVQHLLGITTQMREKQQMARSKVEANRLSVRLELQADCFAGMWGRFIAGEGRVDEADLLTAIKTAQAIGDDRLQRQQQGYAVPDSFTHGTAEQRKTWFMRGYNSGDIKSCDTFASSSLN

SEQ ID NO: 8261 - protein, 254 aa, Proteus mirabilis
YKFFIGELLMKENLLLFLLFLHSTQVFCSEEKIKKTAIIDIDRPIVKGISHNYFEYFNVPPEGVILNNKEAQADTIINEITGDQISFLNGNIHVIGKMAHVIIANPNGIECYQCSASDVTGFTLISGYTKNQGSDFFLSNRNYVYINDVRIFSRVAKNINIISNEVYLEGGIYGNVNDLNITSGLVTYNPQLENKVNSYGRISFFDGFDAYLNKINIKHGYGEIYFDKEAYRIIERKLNINSLFGNRAVYISYY

SEQ ID NO: 8262 - protein, 164 aa, Proteus mirabilis
NKLLRCRLTAPLTFIYLEIVKMILDKETLFSLDQAVTASAVSKQIIDLTPVYGAFRDIGIGEPLELFAQVTEQAKAAGEATVQIKLETATDDKFSDAKSIFESVAMPIADLNAGKRIVAKVPQGVLKYLRLQYVVAEGPLTAGKFTAGINLTVDAHPIYDAVTQ

SEQ ID NO: 8263 - protein, 488 aa, Proteus mirabilis
TRLLTGRYNRKNAPLTINNYIFIIFLTLTLIKESDVISVFDMFKVGIGPSSSHTVGPMKAGKEFVDDLVSQDLIASVTRVAVDVYGSLSLTGKGHHTDIAIIMGLAGNAPATVDIDSIPGFIREVEETGRLPLANGLKVVDFPAESMHFSNDNLSLHENGMTIHAFAGDKEIYRKTYYSIGGGFIVDEENFGKSVLDSQPVSYPYASAEELLKHCKETGLSISSLMMKNELDLHTQAEISAYFADVYKTMQECIEHGLNTEGVLPGPLRVPRRAASLNRLLTSSNSLSNDPMKVVDLINMFALAVNEENAAGGRVVTAPTNGACGIVPAVLAYYDRCIEKVTPEIYTRYFLASGAIGILYKMNASISGAEVGCQGEVGVACSMAAAGLAELLGASPEQVCVAAEIGMEHNLGLTCDPVAGQVQVPCIERNAIASVKAVNAARMALRRTSEPRVSLDKVIETMYETGKDMNAKYRETSRGGLAIKVQCD

SEQ ID NO: 8264 - protein, 301 aa, Proteus mirabilis
GVILMGQISLLIINGKNSGNEALRQAVYQQRKEGNDIQVRVTWESSDIQRFVQEALHIQAQTIIAAGGDGTINNVASELVRLAPSSPPALGIIPLGTANDFATSAQIPLEMDKALSLAIKGRAVPVDIINVNKTHYFINMASGGFGTKITTETPEALKSALGGAAYFINGLLRIDTLKADQCTVEAENFHWKGEALIIGIGNGRQAGGGQQLCPEALINDNKLNITLVEARELLPSLLTSLFDRKKNDKIIERESDWVTISAAHEMVFNLDGEPLLGDKFEFIVLPEAIHCRLPPQCDLLS

SEQ ID NO: 8265 - protein, 107 aa, Proteus mirabilis
RGVLMKNLLLITSLLFSFNAYSYVYGGSNLYGSNYPSFNDMEPSRPYTDDQYSWQNYKNEAERYVDAAKEYVDKANNDIQRIQEAKSEAIENANRVIEEYNRNVRGY

SEQ ID NO: 8266 - protein, 92 aa, Proteus mirabilis
PFSLVRTLAMEKKYEYPAPANYPDVVNTDEGIEKLITKSNLEALLTKMGEDGHDVSAPLVELIAMRNFIVQKMRGNKNIIPLVECILAELKK

SEQ ID NO: 8267 - protein, 105 aa, Proteus mirabilis
LYSFLSNLFLISKTTLEPISAIVNVLENFPVLLPTISLISLIPEKEQSRQEIPLGLAITTVAFFPCNSSSPLRIETSLETTSLIINSASALFFNDKPKLPTSRRL

SEQ ID NO: 8268 - protein, 69 aa, Proteus mirabilis
FISFIINCSYLFLGILLTQFNFIMEINTNRKNTIFVYYLSITKLTLKIIKLFILFYKSITIFTCSCILI

SEQ ID NO: 8269 - protein, 368 aa, Proteus mirabilis
MKKLAISLFFIVMTCVGFSAHAERIRDLTSVEGVRENALIGYGLVVGLDGTGDQTMQTPFTTQSLNNMLSQLGITVPAGTNMQLKNVAAVMVTAKLPPFGRTGQSIDVVVSSLGNAKSLRGGTLLMTPLKGVDSQVYAVAQGNIIVGGSGASAGGSSVKVNQLAGGRISNGAIIERELPSQFGQTGLLNLQLNEENFTLAQSIADAINKLRGVGTALPLDARTVQLRVPLGKSEQVRFLADVQNLEVKRVIADAKVIINARTGSVVMNRDVVLGSCAIAQGNLSVTVDSQVNVSQPNTPFAGGSTVVSRNTSVNVNEKGGSLQKVNASASLNEVIRSLNALGATPTDLMSILQAMESAGCLRARLEII

SEQ ID NO: 8270 - protein, 302 aa, Proteus mirabilis
LWFSTCYFKTIDFSHIICIFATGSQVAFFIFTINVISKLREGFTVYRWALIPLLLLLFLILGSLIALICQLSYHELTMVITDAEFHFAVLMSLSTALTSLCLAVLLAVPAAWVMARSSFKGQRFIDALLDLPLVTPPLVIGIGLLLLLGHQGPLTGVFPQLSRALFSPLGIIIAQTYVASAIIMRNSLAAFKAIEPAYIQTAQNLGLTPTKTLILVEIPLCWSVLISGCIVAFSRALGEFGATLMLAGATRLKTETLPMAIYLNIASGDFSLAIGCALVLIAIAITLLFALHRLQRDRKLAC

SEQ ID NO: 8271 - protein, 63 aa, Proteus mirabilis
EMKFKISDKVRIVKDTLDGEMDGYTGVFARYDHHDDSLLNYYVEFDDGGENWFLEEELELINE

SEQ ID NO: 8272 - protein, 94 aa, Proteus mirabilis
HAASPSQLICLGDNPKEQATASNNRPQDDASGEFKPRATALLKICNSVSGIAWVITLPCQSFVKVAKCANQFRQGCIEAKFPPGIATAGSPPIR

SEQ ID NO: 8273 - protein, 72 aa, Proteus mirabilis
YQHSLYIHIQGTRIDFVTVGFPLLYDHNKRTSDWCRLVVLPVPDHLARAACTQAVGAFHTSPAPVLSGLNQI

SEQ ID NO: 8274 - protein, 77 aa, Proteus mirabilis
ILSSKIRFNLMKKIIIFGATGNVGSYLTRYCTEFFDKDEFEIIAVGKRDTDAFNIYNIKYISVDIYKLGRFRKITYG

SEQ ID NO: 8275 - protein, 282 aa, Proteus mirabilis
QLKSPSFRIEYMSQTKTSLMGQCISEFIGTALLVFFGLGCVAAARIAGAQLGLWEISIIWGLGVALAVYLTAGTSGAHLNPAVTVAFWLFACFERKKVIPYIVAQMLGGFFAAAVVYFMYYNLFIDYEQVNGIVRGSQESLFTAGVFSTYPAAQISVIHAFFIEVIIAVILVGLILALTDDGNGVPRGPLAPLLIGILIAVIGGAFGPLTGFALNPARDFGPKLVAFFAGWGDIALTGGRDIPYFLVPLIAPMIGGILGALAYRKLIGRHLPCDTCKIENDK

SEQ ID NO: 8276 - protein, 336 aa, Proteus mirabilis
ITMLKRWGLLTTLALTALFTQSIWAKDIQLLNVSYDPTRELYQQYNHAFSQYWQQKTGDHVTIRQSHGGSGKQATAVINGIEADIVTLALAYDIDAIAQRGRIDKQWITRLSDNSAPYTSTIVFLVRKGNPKQITDWDSLIKPGVSIITPNPKTSGGARWNYLAAWGYGLKANQQDSEKAKAFVKSLYQQVEVLDSGARGATNTFVERGIGDVLIAWENEALLAINELGTDKFEIVTPSVSILAEPTVSVVDKVVDKRGTREVATAYLEYLYSPQGQEIAAKNYYRPRDKSIAEKYQKRFPTLQLFTIDELFGDWQSAQQTHFATGGIFDEISRRD

SEQ ID NO: 8277 - protein, 376 aa, Proteus mirabilis
IKKPSHLCILDNDGFFATKKQSFNQTISTEVWGLQQNNKESAQATMKDVAFAAGVSTATVSRTLMNPEKVSSQTRQKVEQAVLDVGYYPHNLSKNLKRNESKTILVIVPNISDPFFTDVVCGIEETAAQHGYLVLIGDCKHQQKHENAFINLIITKQIDGMLLLGSHIPFDVSKEEQKNLPPMIMANEFAPELELPTVHIDNLTASFRATHYLQQMGHKRIACITGPEDMPLCRYRLQGYIQAMRRTGVPLREDYIIRGDFTHESGAESLKKLISLPEPPTAVFCHSDIMAIGVMWQAKKLGLQLPDDLSVIGFDNLDITRYSEPALTTMEQPRYQIGRQSMLLLLDQLQGRPVAPGSRLLDCELIVRESVCRLKS

SEQ ID NO: 8278 - protein, 313 aa, Proteus mirabilis
RPLPLNRLSFHLIAISIQLFRDKKQSYSIQCSLYCCASTEFEFIDKLNLNHSVGGKVMRHPLVMGNWKLNGSIHMVHELIAALRKEISGVAGCDVAIAPPTVYLCQARHEIGGSRIALGAQDTGVNLSGAFTGETSPEMLKNVDVKYVIIGHSERRTYHKESDEFIAQKFGVLKELGLTPVLCIGETEAENEAGKTQEVCARQIDAILNAHGAQAFKDAVIAYEPIWAIGTGKSATPAQAQAVHKFIRDHIAKQDATIAEQVIIQYGGSVNDKNAAELFSQPDIDGALVGGASLKADAFAVIVKAAAEAKAKK

SEQ ID NO: 8279 - protein, 513 aa, Proteus mirabilis
QQFTNTLIERSLNMKLKKKRNKPLRINDITIIDDSKLKKAITAAALGNAMEWFDFGVYGFLAYVLGQVFFPGASPGVQMIAALATFSVPFLVRPLGGVVFGMLGDKFGRQKVLSVTIIIMALSTFAIGLIPGYDTIGIWAPVLLLLAKLAQGFSIGGEYSGAAIFVAEYSPDRKRGFMGSWLDFGSIAGFVMGAGVVVLISTIMGEAAFHEWGWRIPFFLALPLGLIGLYLRHALEETPAFQQHVDEMNSDDRKSIENPPRVSLREIASKYWKSLTVCVGLVIATNVTYYMLLTYMPSYLSHNLNYSADHGVLIIIAIMIGMLFVQPVIGLLSDKIGRKPFVIGGSVGLFILAYPAFMMINSDEIGLIFLGLLILAVLLNCFTGVMASILPAIFPTHIRYSALAIAFNISVLIAGATPTAAAWLVEATGNLYMPAYYLMVVAVVGLITGIKMIETANKPLRGATPAASDKSEAKEILSEHYDNIEQRVEDIEAEIEALQKKRQALIDQHPKLD

SEQ ID NO: 8280 - protein, 515 aa, Proteus mirabilis
KQVTNMTTETNKSNSEKKYIVALDQGTTSSRAVVIDHDANIVSISQREFTQIYPKPGWVEHDPMEIWATQSATLIEVLAKEDIPSDHVAGIGITNQRETTIVWEKETGKPIYNAIVWQCRRTADFCTRLKDQEGVEEYIRQNTGLMVDPYFSGTKLKWILDNVEGARERAEKGELLFGTVDTWLVWKMTQGRVHVTDYTNASRTMLFNIHSLDWDQKILDLLNIPRNMLPKVVPSSEVYGQTNIGGKGGTRIPIAGMAGDQQAALYGQLCVQSGMAKNTYGTGCFLLMNTGKEAVRSNHGLLTTICCGPRGEVNYALEGAVFVGGASIQWLRDELKLIDEATDSEYFATKVNDTNGVYVVPAFTGLGAPYWDPYARGAIFGLTRGANRNHIIRATLESIAYQTRDVLDAMQADSGARLQALRVDGGAVANNFLMQFQSDILGTRVERPVVRESTALGAAFLAGLAVGFWSDLEEVKNKAEIDKEFRPGIETTERNYRYNGWKKAVARAQEWEDRG

SEQ ID NO: 8281 - protein, 177 aa, Proteus mirabilis
LMTTIVSVRRNGQVVIGGDGQATMGNTVMKGNVRKVRRLYNDKVIAGFAGGTADAFTLFELFERKLELHQGHLTKAAVELAKDWRTDRMLRKLEALLAVADETTSLIITGNGDVVQPENDLIAIGSGGPYAQAAARAMLENTDLSAREIAEKALNIAGDICIYTNHNVNFEEISSKE

SEQ ID NO: 8282 - protein, 262 aa, Proteus mirabilis
YSITNSTVGGFMFDLTGKIALVSGGAKGIGKGIVSALKNSGAQVIIADIDDVAGNATKQALGVDFMHLDVTSQAACEQVVNDIVKQYGKLDILCSNTGIFPQATIKEMSEADWDKMHTVNLKGMFFLVKAALAVMEKQQYGRVIITSSITGAITGYPGWSHYGASKAGQLGFMRSAALEYARHGITINAVMPGNILTEGLQAQGETYLNQMKASIPTHTLGEPEDIGYAAAFFASNEAKYITGQTIIVDGGQILPESPEALL

SEQ ID NO: 8283 - protein, 61 aa, Proteus mirabilis
ASKTTFCTELAKSCFNQRTAGFFFLFRSDANIITHSNPDNPNVVYNQYIKFLQKISTYRYP

SEQ ID NO: 8284 - protein, 651 aa, Proteus mirabilis
SPKTCRTFVACKIKYAFYLILAASCYLFLLDADFMNNKKVFFLSSVALSVMTSSFNLFAQADNTLSVTANRFQQPTSSILAPVTIVDREQIDRWQSNSVLDVLRRMPGIDVAQSGGIGQMSSVFVRGTDSRHVLILIDGVRTNQAGISGSYDMSQLPLSLVQRIEYIRGPRSAVYGSDAIGGVINFITKRPNDGLTLNAGIGSHGYQNYNGSIQQKVGERTTLSAAGGYTYTKGIHATDDSVPVAAPFHDRHGFMNKSYWFGIDHIFNDNFQGYMKGYGYDNRTTYVASYPGNTDQSKTYNRNYEAGIKFSGDSYFSQLITVYSQTKDYNYISTNGRDGKGSSVDNSKQYNVQWGNTFLIPSGMISAGMDWQRQTIEANSASVPHQRTIDNTGLYLTSQKQLSSVIVEGAIRSDHHDEFNWHTTWQTSASWEFVDNYRVIASYGTAFKAPTLGQLYADNPTWNTKGNPNLKPEKSKQWEVGVEGLTQGIDWRLSLYQNDIDNLIAFRDNTYINYNKAKIKGAEWVGEMDTGSLHHQLTLQYLDARDSDNNLLSRRAKQQLKYQVDWNIADIDIGINYQYIGKRYDTDFNQYPTKRIKLGGVSLWDLTASYPITSHLSIRGRIANLFDKDYETAYGYRTPGREYFLTGSYNF

SEQ ID NO: 8285 - protein, 250 aa, Proteus mirabilis
EIMANWVTGKVIQVRYWTDTLISLVVHAPIDKFTAGQFAKLALEIDGERIQRAYSYVNSPQDPNLEFYLVTVPEGKLSPRLAALTVGDELLVTEQASGFFVLEEVPSANTLWMLSTGTAIGPFLSILQLGDDLDRFENIVLVHAVRYARDLSYLPLMELLAERYQGKLRIQTIVSRENHIGSLTGRIPALIESGALEKTVGLTISPEESHIMLCGNPEMVRDTQQLLKTQRDMRKHLRRKPGHITSEQYW

SEQ ID NO: 8286 - protein, 745 aa, Proteus mirabilis
YYLFAKTLGNPDMTIVQVILPVPLFSSFDYLLPEGCAMPTIGCRVVVPFGKQRRSIGIVKGFSSHSEFPIEKLKPIEEVLDTETLFPGILWDMLNWASAYYHYPLGEVLFHAMPILLRQGKPAEFTPLWQWYATQEGEALDLNSLKSAKKQQQALAALRRAPLYRHQLDEYEITTATLNNLKKKALADLRPIQPAPIQWQSTFAVQGERFKLNAEQAVAVGAITAQADQFSPWLLLGITGSGKTEVYLSVLETILAQGKQALILVPEIGLTPQTIRRFKARFNAPVDVLHSGLNDTERLAVWLRAKRGDNAIIIGTRSALLTPFQQLGIIIIDEEHDGSYKQQDGWRYHARDLAVFRAKQENIPIVMGTATPSIETSYNVAQKKYQQLTLTQRAGNAKPATEHLIDLKGQPLTTGLSPTLIKAIKEHLNAGNQVMLFLNRRGFAPALLCHECGWIAECPRCDHYYTLHQKHGMLRCHQCDSQRRIPSQCPQCGSTNLMPVGLGTEQLEQGIGELFPNTPITRIDKDTTSRKGALEQQLEDIYQGGSRILIGTQMLAKGHHFPDVTLVALLDVDGALFSSDFRAAERFAQLYTQVSGRAGRAGKQGAVYLQTHQPDHPLLLTLLEKGYDAFTKEALQERQATFLPPYSSHIMIRSEDHNNQKAPQFLRQLKQFFEQHPMRDSHLWVMGPIPAIQAKRGGNFRWQLLLQHPSRGYLQKLMSVTYPQIVALPESKKVKWNIDVDPTDC

SEQ ID NO: 8287 - protein, 203 aa, Proteus mirabilis
  UNSURE (14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(72),(78),(79),(89),(90),(103): Identity of amino acid at the above locations are unknown.
TLAAGPARAVDHAXXXXXXXXXXXXXXXXXXXXXXXXXXXXXXXXXXXXXXXXXXXXXXXXXXPPPPPPPPXPPPPPXXPPPPPPPAPXXPPPPPPPPPPPSXPPPPHPILPFLSPLLFYYIYLFHPIYYLSFPIFPSSYTTLSFPSLFILSPLYPSASLTLICHFFNIFILLYIFPFLSILSYSFITYLNLLFNLSPHTHTP

SEQ ID NO: 8288 - protein, 455 aa, Proteus mirabilis
SLFLILLCTFISICWFIRWWPIRRTEENVMESDPYFHDCFYLLFLRRINRRTNWIYYPGSYLMNNIYNVSEKLFQLNDFSKKTRQDLHKIPELSGEEYKTSKYCRELMESFGYQIKTFDGYTGFTADLIVNADFPLIAIRADMDGLEMPDLTNNEHSSIHQGCAHNCGHDTHMTIALTAAKYLAENQAEMSANVRFIFQMAEEDMRVPGADKMVELGCMEGVDETYALHNDAAIETGCVRFNDGVMSSYGSAWTLDVYGVSAHGSTPHKGLDAIREATRLIDYMDYVVAKKTDPFSPAVFGCGMINGGTIPNALADHVQARGTIRSMDENTDKVLKESFNEIVARSTAGGFKTTLTATGYPAVINHPTAYQRLLEATRQFLPEENIESNGKPMTGSEDFSYMVNATKGKVGAMFFLGSGNQAKGINNYLHANPYFVDDDCLLVGAQIFVNLLTRK

SEQ ID NO: 8289 - protein, 310 aa, Proteus mirabilis
VLNFSMSAQHSISRTQAWLESLRPKTLPLGLIAIVTGSALAYWTGHFELPIALLAILTAGTLQILSNLANDYGDAVKGTDTEERLGPLRGMQKGVITPAQMKKALIINVIISCVSGIALIIVACKKPEDAIGFLVMGLLAIVAAITYTVGKRPYGYMGLGDISVLIFFGWLSVIGTYYLQANAFNIVTLLPATACGLLSVAVLNINNMRDLENDIQAGKNTLAVRLGASGSRIYHTCVIAIAIICLIVFTLIYMHRWTAWLFLLAVPMLLLHIKRVNADLSGEAMRPLLEHMVKAALLTNILFSLGLVLE

SEQ ID NO: 8290 - protein, 78 aa, Proteus mirabilis
NESYSTSLFLTLAILKSSLVTKERLMSKIEKHVDQLKDKATEVKHRTEEKLSEVAHDLKHGASDLKENVEKKIDSLKK

SEQ ID NO: 8291 - protein, 470 aa, Proteus mirabilis
NRSLPMQHSHFDAIVIGSGPGGEGAAMGLVKQGKRVAVIERYDQVGGGCTHWGTIPSKALRHAVSRIIEFNQNPLYSDQSRLINSSFSQILRQASTVISQQTKMRQGFYERNHCTMYSGEAAFIDDHRISVRYPDGTCDILSADNFIIATGSRPYCPPDVDFSHSRIYNSDTILDLEHEPRHVIIYGAGVIGCEYASIFRGLRVKVDLINTRDHLLSFLDQEMSDALSYHFWNNGIVIRHNEDYDTIEGVDDGVIVHLKSGKKVKADCLLYANGRTGNTDTLGLENVGIKTDSRGQVAVNAHYQTSCEHIYAVGDVIGYPSLASAAYDQGRIAALALTTGTSETHLIEDIPTGIYTIPEISSVGKTEQQLTAMKIPYEVGRSQFKHLARAQIAGMNVGSLKILFHRETKQILGIHCFGERAAEIIHIGQAIMEQKGEGNTIEYFVNTTFNYPTMAEAYRVAALNGLNRLF

SEQ ID NO: 8292 - protein, 391 aa, Proteus mirabilis
YQYHKLWVLSQCGSYAYWFFRENTYMETITVTSPLFPPLEELEPYLKDIWKRKWLTNNGYYHQRLEEALCKYLNVPYISLYSNGTLALIAAINVLKLKGEVITTPYSFVATSHSLLHSHITPVFVDIEPNTYNIDPNKIEAAITDKTTAILPVHVYGRPCNHEAIQKIADKYNLPVIYDAAHAFGVKENGNSILNRGNLSILSFHATKTYSTIEGGAIICHSAEMKEKLDKYKNFGYTNETEIDELGFNAKLNEVQSAFGLLTLDYIDKAIEKRKEVSDFYKTNLSNVPGITLPNIPKDLTWNYSYYPIIIDKDRYGKTRDELYLELKENKILSRRYFYPLITDFNIYNQYKTKTPIAEKISENVICLPIHHLLSNDDLNRIINIIKYDYK

SEQ ID NO: 8293 - protein, 136 aa, Proteus mirabilis
VHFQVSSPSDLITELQGRLPIRVELQALTAEDFERILTEPNASLTKQYQALMATEGVSINFSQDGIRKIAESAWRVNETTENIGARRLHTVLERLMEEISYDASERQGETILIDAEYVKQHLDELVADEDLSRFIL

SEQ ID NO: 8294 - protein, 157 aa, Proteus mirabilis
SFHQRQNCMKNIIIDMKLVFVAILLAMFTQTLTSGIAIYAMWDSFIAMSVVVFISLVAKQYLPSSLPTFAYATIIGILICLPETPVREFFISSIGKVSFLSCCVPLLAFAGLSVGGQLEELKKMSWKVILIFMIVSTCCFFGASIVAQIGFTIQGVI

SEQ ID NO: 8295 - protein, 134 aa, Proteus mirabilis
MMEQNRCEKSTLLLSVVIGVALHGSYSTLFNPLTGPWSIFPLISLVLAVYCLYQRYLNQPMTDGMPKLIFSFFLLGLFGYNAYLKTSNPEMGSNFFSSVCIVIIALWIYRQIKQRKRLREQEEDAEKASQAEQY

SEQ ID NO: 8296 - protein, 349 aa, Proteus mirabilis
KYINRFVFIVQGKNDMLNTLIVGASGYTGAELAAYLQQHPHVNLSRLMVSAQSVDAGKCFSELYPQYRGLVDLPLEPMVDVANAAKNIDIVFLATAHEVSHDIAPIFLAQGCVVFDLSGAYRVQNKHFYQQYYGFEHKNTDWLSQAVYGLAEWNADQISQAQLIAVPGCYPTVSQLSLKPLVEAGLLDSTHWPVINATSGVSGAGRKASLTNSFCEVSLQPYGVFTHRHQPEIATHLGIDVIFTPHLGNFARGILATITCKLKQGVTENEVRQAFETAYQGQPLVRVYDKGLPALKAVVGTAFCDIGLAQQGEHLIIVGAEDNLLKGAAAQAVQCMNIRFGFAPTETLI

SEQ ID NO: 8297 - protein, 233 aa, Proteus mirabilis
RMHKILLVDDDRELTSLLKELLEMEGFNVVLATDGEQALKLLDASIDLLLLDIMMPRKNGIETLKELRQNFQTPVIMLTARGSDLDRVLGLELGADDYLPKPFNDRELVARIRAILRRSNWSEQKQTDGNTSPILQVDKLQLNPGRQEASFDNEPLELTGTEFTLLYLLAQHLGQVVSREHLSQEVLGKRLTPFDRAIDMHISNLRRKLPERTDGQPWFKTLRGRGYLMVSIT

SEQ ID NO: 8298 - protein, 219 aa, Proteus mirabilis
RYSNPHREQLHIFRSALISRYYNRMRSGTMRKVAMVALASMFLVAPTVVMAETSNTNNQPAGQQQYNDNYHCGYGYGMHDGRDNRGHRGQRGHMMGNNNFGESRMFNGITLTEQQRTQMRDLMRQHHQDRFNNSDFRQRHENMHKLITADKFDEAAVRAQIQDMDKQAIERRVEMAKVHNQMYQLLTPEQKAQLEKNYQQRVSSVSVSQQNQQTQEKAN

SEQ ID NO: 8299 - protein, 299 aa, Proteus mirabilis
PTCLIKIMRQLMAIARQDVNISSPEATTSDAQSTANPTVLVFDSGVGGLSIYREIREKLPDAHYIYVFDNEAFPYGEKPQEFIIERVVRIVSAVAQQHELAAIVIACNTASTVSLPALRAKFTDIPIVGVVPAIKPAAKLTCNGVVGLLATRATVKRPYTHELIERFATECKVHLLGSAELVELAEKKLHGEKVSCDELRRILAPWLKMKEPPDTVVLGCTHFPLLEEELLSVLPDGTRIIDSGGAIARRTAWLVVNQDKIRGSKEISFAYCLKEDEYSELLKPVLADFGFKTLRKLAL

SEQ ID NO: 8300 - protein, 86 aa, Proteus mirabilis
QNCFKRCNAACSLAGNILVDDIGSAKSGALNGETAFWCALISGAGNEALSCDRNSRKNAVLKGVKTLYISPCWVTTFPGGTKMLSW

SEQ ID NO: 8301 - protein, 274 aa, Proteus mirabilis
RMDKSRSPIKVFFISILAVLFLIFISQYVIGKKEIKIGIAVIPILPMLFAVIIGMFMSAGFTRKKIKVWGKLFTEKEEGFCGKMVGFSLLILGTQYAGMIVPNIKMILSVGIPLFVQELGNLLPVLIAVPLAIKFGFGRRAIGACSSISREPSIAVIQGRFGTGSQEYIGVLAIYLCGSVIGTLWFSVLGSLAPLTGLHPLALAAGSGVGSGSMLSAASGALINGLDEALAQQVLSVAAASNLLSSALGALSLTYLGLPLSEKIYKVFTRGKTA

SEQ ID NO: 8302 - protein, 115 aa, Proteus mirabilis
LGKKFDYKGDHAVYVISKNTALELIEHYHQEYNLRKFIFRLPTIYNYSPYHYYYPNGKKTKRPLYQMIEKAEKGEDIELWGDPNHSTDMVYVDDFSQMLCKAVLVDRDQGVYKSS

SEQ ID NO: 8303 - protein, 99 aa, Proteus mirabilis
STLNWRNCTVLNEWEGIVVYGAVRQVDALSELDLGIQAMAAIPAGCPSEGIGDSDIRVNFGGVTFFSGDYLYADNTGIILSEEPLGLDDDDLDDDLLEE

SEQ ID NO: 8304 - protein, 270 aa, Proteus mirabilis
LSANRTVAQRDYVGRGQSSARRKKTTKGKGKKAASGLPLTTLIVAIALVALFVGGLYFITHNKKEVVEPTSSSAGQQPTNNLPPKPQERWQYIKELENRQVGNPLQPPATSSGSQINPKATLSPEQLRFLQQIEADKRQPAVELPEVPYNGEVPRSQVVITPPTTTAPSVQPSQPSAPVKQEPAPAITTPKPATTEARFLVQCGSFKTNEQAESVRATLAFSGIESRVTKGNDGWIRVLSGPFNKEQANTLSRQAAGAGVSGCILRTAGG

SEQ ID NO: 8305 - protein, 149 aa, Proteus mirabilis
VYIEKLLMTLQHWAFSFKGRIGRCDFWAGFALCFVLFCGLYTVNQHYSLPAVLVGIISLAILYPLCAIFTKRLHDRNKRGAWLLLLLLAVMLGLTDTSSLEPFWQWAIGRFLPSFIMMIMLLDCGVFIGTQGENYFGATTEKVDYSSFR

SEQ ID NO: 8306 - protein, 99 aa, Proteus mirabilis
TVVDRLLTIGSIDYMGDYSMSFEVFEKLESKVQQALDTITLLQMEIEELKEKNDALNQEVQGARESREALVRENEELKQEQSSWQERLRALLGKMEDVQ

SEQ ID NO: 8307 - protein, 106 aa, Proteus mirabilis
SMAEWNGEYISPYAEHGKKSEQVKKITVSIPLKVLKILTDERTRRQVNNLKHATNSELLCEAFLHAFTGQPLPNDEDLRKERNDEIPEEAKEIMRQRGVDPETWEY

SEQ ID NO: 8308 - protein, 396 aa, Proteus mirabilis
YYYEERLSTVNIKLPTFIELYRQLIATPSISATDAKTDQSNEALINLLANWLETLGFSIEIQPVPETRGKFNLLATLGSGTGGLLLCGHTDTVPFDEGRWTQDPFTLTEKEGKLYGLGTADMKGFFAFIIDALRDIDTSQLTHPLYILATADEETSMAGARYFAANTAIRPDFAIIGEPTSLQPIRAHKGHLSNAIRITGQSGHSSDPEKGVNAIELMHESITHLSTLRDRLKTRYNNPAFVIPYPTMNFGYINGGDAANRICACCELHMDIRPLPGLTLQDLDDLLHETLAPVKARWPGRLSVEALHEPIPGYECPTDHKMVAVIEKLLGEKAQTVNYCTEAPFIQALCPTLVLGPGSIEQAHQPDEFIDMAFIEPTRELMEQLIENFCLAEKAK

SEQ ID NO: 8309 - protein, 83 aa, Proteus mirabilis
LSSLYKHYTSLSSLYYTDKLTLFIQILYSLLLSISKNSVLAIYYYQDIKCNGLIDGLLNTLRAVIDTFLSFGINRKSAHPTQL

SEQ ID NO: 8310 - protein, 160 aa, Proteus mirabilis
EMKDSRWDEISIYNRRVMEKGKVGLGEGGGGRRGGGGGGGGGGEKGGRGVEGGEGRGGGGEGRGGGGGEGEGKKKKKKKEKKKKKKKKKKKKKKKKKKKKKKKKKKKKKKKKKKKKKKKKTRGRRPGLVLPPAFNLSHDQTLQLKVFDAQRNRKLSLFII

SEQ ID NO: 8311 - protein, 581 aa, Proteus mirabilis
NKKEMRHMSKQTVATYIAKVLHNAGVKRIWGVTGDSLNGLSDSLRKMGTIEWMGTRHEEVAAFAAGAEAAINGELAVCAGSCGPGNLHLINGLFDCHRNHVPVLAIAAHIPSAEIGSNYFQETHPQELFRECSHYCELVSNPDQIPQILAIAMRTAILKKGVAVVVLPGDVALKPAPEDAHENWYPLQSPLIMPNRFEIEKLSEALNNAKNITLMCGAGCAQAHDEVVKLAQTLKAPVVHALRGKEYLEWNNPCSVGMTGLIGFSSGYHAMENADTLVLLGTQFPYRAFYPAKANIIQIDLNPSSIGSHCHVDMAFVGDVKATLNALQPRLKEKTDTAHLDASLKHYAKARKDLDALAQPSERELIHPQYLARRLSELANDDAVFTCDVGTPTVWAARYVKMNGKRRLIGSFNHGSMANAMAQAIGIQALDRKRQVVAMCGDGGFTMLMGDFISLAQMNLPVKVVIFNNSVLGFVAMEMKAGGYLTDGTDLHNPDFAAIANAAGIKGIRVEKGEDLDEALKTAFEHDGPVIVDVVTAKQELSMPPEIKFEQAKGFSLYMMKAIINGRGDEIVQLAKTNWLR

SEQ ID NO: 8312 - protein, 171 aa, Proteus mirabilis
  UNSURE (24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(75),(83),(88),(90),(93),(99),(100): Identity of amino acid at the above locations are unknown.
LKSLIMAQIERWRQDQPGPSTTRXXXXXXXXXXXXXXXXXXXXXXXXXXXXXXXXXXXXXXXXXXXXXXXXXXPXPPPPPPPXPPPPXPXPPXHPPPPXXPPPPPPPPPPPPPPPPLTQSYLSFLHYSSIIYTYFIPSTIFHFLSFLHLTLLSLFLLSLSFLHSILPLPSL

SEQ ID NO: 8313 - protein, 397 aa, Proteus mirabilis
LNYCVFLIKNRLSIMKILHLINLQGFGGAERLFIEYLKNSSFQNEVLCTSNSLNKNLIPELKHFDIKYANKIASTKIKYPAFLRKHVLTKKIEASKADVTLVWDFVPRLSRKPKNTSLVYYDHGCSWQYPMNKKTQIFFEMLDSAIAVSKASKRVMELRFKPKFDINVVINRLPHIEYKESRTFIKQNIITVGVASRLVGLKGIGIAIIALKELRNKNIPAKLIIAGEGEQRSDLENLVSKLNLEDSIEFIGYQSDMSIFYSKIDIYLSTPILEAFGLSCIEALSNGIPVIFPKLNGQPEAIKDKYCGLGIAPKLSIDEYHKLTNLDINFPYKVYDPISDTLILPKLISPQNCATAIIEIMNNYTNFSQNAIEWSKETTDYNLFIKEFESTIRDSQI

SEQ ID NO: 8314 - protein, 892 aa, Proteus mirabilis
KVCCYRHKAKVRSLMNQQYSAMRSNVSMLGKLLGDTIKEALGEEILDKVESIRKLSKSSRAGNEVQRQKLLLTLQNLSNDELLPVARAFNQFLNLTNVAEQYHSISPHGEAASNPVALAKLIERLKDKNFTNQQLKQAVEQISIELVLTAHPTEIARRTLIHKLVEVNTCLSQLDHDDLADYERTNIMRRLRQLVAQSWHTDEIRKIRPTPIDEAKWGFAVVENSLWEGVPAFLREFNEQLEESIDYNLPVEASPIRFTSWMGGDRDGNPNVTAEITRHALLLSRWKAADLFLNDIQVLVSELSMTESTPELRELAGGADVAEPYREIAKQLRTRLQVTRDYLEQRIKGQQSLPPEGLLIDNSALWEPLYACYQSLHQCGMRIIANGQLLDTLRRIRCFGLQLVRLDIRQESTNHTEALSELTQYLELGDYASWSEEQKQTFLLTELNSKRPLIPTHWQPSEATKEVFETCRVIAESPKDSIASYVISMAKVPSDVLAVKLLLKEAGADIRLPVAPLFETLEDLNNAESVMTRLFDIPWYRDLIDNKQMVMIGYSDSAKDAGVMAASWAQYRAQDALIKLCEKSGVTLTLFHGRGGTIGRGGAPAHAALLSQPPGSLKGGLRVTEQGEMIRFKFGLPQVTISSLAHYAGAILEANLLPPPEPKTAWIEVMDALSDVSCEMYRGYVRGEKDFVPYFRAATPEGELGKLPLGSRPAKRRPTGGVETLRAIPWIFAWTQNRLMLPAWLGAGAALQHEIDNGKQAVLDDMCENWPFFNTRIAMLEMVYAKADLWLAEYYDQRLVEENLWPLGAKLRQQLSDDIKSVLAISKDEHLMADLPWVAESIALRNVYTDPLNVLQAELLQRSRTHSESDPRIEQALMVTIAGIAAGMRNTG

SEQ ID NO: 8315 - protein, 390 aa, Proteus mirabilis
QGVCMTKKTATIAIHNGLNEDKQYGCVVPPIYLSSTYNFLASNQPWEHDYSRRGNPSRDMVQNALAELEGGVGAVVTSSGMSAIHLICTTFLKPGDVIVAPHDCYGGSYRLFNSQQQRGAYRVVFVDQNDEQALQQALALAPKIVFIETPSNPLLRITDIEKISQLAHQVGALVVADNTFMSPVLQKPLALGADLVVHSCTKYLNGHSDLVAGVVISQCRKQLEDLSWWANNIGVTAGAFDSYLLLRGIRTLVPRIRLQQENTQALVDYLQTQPLVDKIYYPALEHHVGHVIAKKQQQGFGAMLSFELKGGIETIKSFLSHLTLFTLAESLGGVETLICHPATMTHAGMSEEARKTAGISNALLRISVGIEDSLDLINDLQNAFNAATKR

SEQ ID NO: 8316 - protein, 350 aa, Proteus mirabilis
LTACLCQLTQVLLMNINQLKSFVEVVRNDFNITNAAEKLYTSQPTISKQLKILEDELSVSLFVRKNNNLLALSPMGKEVHKIASDILGQVDKIKSIVAEEDRNKKVDLHIATTHTQIRYSLPNVIDHFRRYYPNISLHFHQGAPAQLAEMVKNGDVDFAIATESMHLYEDLITLPCYRWTRSLLVPYDHPLASLPDDQQVTIEQLGQYPLITYVFGFTRGSKLDKVFYKNHLKPQVALTATDTEIIKYYVKRHLGIGVIATVAYDEIEDSQALKCINIDHLVQPSYTHICLSKHTHMKDYMHEFISLYAPHIDRNIIQMPEQWETQWHSKEVYQGLPDLISVNSKEKIIE

SEQ ID NO: 8317 - protein, 172 aa, Proteus mirabilis
  UNSURE (20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(69),(71),(77),(79),(84),(86),(89),(95),(96),(108): Identity of amino acid at the above locations are unknown.
SWLRLNAGGRTSPGRRPRVXXXXXXXXXXXXXXXXXXXXXXXXXXXXXXXXXXXXXXXXXXXXXXXXPXPXPPPPPXPXPPPPXPXPPXTPRPPXXPPPPPPPPPPLXPPPPSPNPTFPFSITLLLYILISSHLLSFISYLSFILHYSLFSFSLYPFSTLSFRFPHFNLSLL

SEQ ID NO: 8318 - protein, 412 aa, Proteus mirabilis
TQLRIKVITMTKGIKKIVLAYSGGLDTSAIIPWLKEHYDNCEVVAFVADVGQSREDLEGVEQKALASGASECYVVDLREEFIKDYVYPVLKTGALYEGSYLLGTSMARPVIAKAQVELALKLGADALAHGATGKGNDQVRFESTYTALAPQLKVVAPWREWDLRSREALLDYLKVRHIPTTATLEKIYSRDENAWHISTEGGVLESPWNASNEDCWAWTVDPKKAPDTPEQVSVTVKAGEVVAINGKAQSPYECLATLNTLGVKHGIGRIDIVENRLVGMKSRGCYETPGGTIMMAALRGVEQLVLDRDAFKWRQQLGLEMSYVVYDGRWFTPIRASLQAAADSLATEVNGEVVLELYKGHVNAIQKKSDNSLYSEEFATFGEDEVYDHSHAEGFIRLYSLPSRIRALSKKK

SEQ ID NO: 8319 - protein, 112 aa, Proteus mirabilis
DWVRGGGGGGGGGGGGGGGGKKGGGGWRGGRGEGGGGRGGGGGGGRGKEKKKKKKKKKKKKKKKKKKKKKKKKKKKKKKKKKKKKKKKKKKKKKKKKRVVDGPGWSCRQRSI

SEQ ID NO: 8320 - protein, 320 aa, Proteus mirabilis
GFESMSEMTPREIASELDRFIIGQDKAKRAVAIALRNRWRRMQLDEALRHEVTPKNILMIGPTGVGKTEIARRLAKLANAPFIKVEATKFTEVGYVGKEVDSIIRDLTDSAVKMVRSQAIEKNRYRAEEMAEERILDVLIPPAKNNWGVTESASSSEPSAARQAFRKKLREGQLDDKEIEIELAATPMGVEIMAPPGMEEMTNQLQSMFQNLAGQKQKARKMKIKEAFKLIVEEEAAKLVNPEELKQQAIDAVEQHGIVFIDEVDKICKRGGQSSGPDVSREGVQRDLLPLVEGCTVSTKHGMVKTDHILFIALGAFPGL

SEQ ID NO: 8321 - protein, 481 aa, Proteus mirabilis
IKRGYMHSAPVHLVWFRHDLRVTDNKALFYACQNTQAQVHAIFTVTPAQWKAHHMALSQQAFIHDALLNLSHSLAKLNIPLTLIISDTYADAAQSIVDYCQQHQVTALFFNHQYALNEQNRDKKVMELLAHNTTVYCYHDNIFVPPGNVVTQQGEMYKVFTPFRTAFLRLFLSQDNASLPAPEIRAHQKAVSPLSAPLFALPISSTKMFPASEQAALQRLKQFCYERVIHYAKWRDIPAIDGTSQLSPYLAIGLVSVRQCFNRLYQTEPDFLENNHSSAFVWFNELVWREFYQHLIVANPSLSKQIAFQPWTENIRWRNDQTEFTAWTQGLTGFPIIDAAMRQLNQTGWMHNRLRMLTASFLVKDLLIDWRWGENYFMSQLIDGDFASNNGGWQWAASTGTDAVPYFRIFNPTTQGRKFDPDGEFIRHWLPELADVPDRYIHTPSEWAIKTGHYLDYPQPIVDHAKARVTAIASYEEAKKR

SEQ ID NO: 8322 - protein, 111 aa, Proteus mirabilis
GGGGEEGGGGGGGGGGGKRGAGGGGGGGERGGGGGEGGGGGGGGRKKKKKKKRKKKKKKKKKKKKKKKKKKKKKKKKKKKKKKKKKKKKKKKKNAWSTARAGPAASVQSEP

SEQ ID NO: 8323 - protein, 260 aa, Proteus mirabilis
GRFMEPLIIKLGGVLLDNEKALTRFFTALQEYRTSHSRPLVIVHGGGCLVDSLMKKLQLPVVKKQGLRVTPADQIDIITGALAGSANKTLLSWATRFGLNGVGLCLGDGQLAKVTKISDELGHVGNAEPGSPELLNLLLNAGYLPIISSIGVSIQGELMNVNADQAATAIAETLGADLVLLSDVSGILDGKGQKLTEISATKAQALIDQGIITDGMIVKVNAALEAAKTLRRPVEIASWRHAEKLTDLFNGMAIGTRILA

SEQ ID NO: 8324 - protein, 466 aa, Proteus mirabilis
KIFMINSLSARIFAIFWLTLALVLVLVMMVPKLDSRQLTTLLESEYRQGVMLEQHIEAELAQDPANDLLWWRRLIRAIDKWAPPGQRLIIVTSEGRIIGAQRNEIQVVRNFMGQSDNADHPKKKKYGRSEMLGPFSIRDGEDHYQLYLVRPSSSPQSDFINLLFDKPLLLLIFTMLISTPLLVWLSWSLAKPARKLKNAADDVAKGNLRPHPELETGPQEFLAAGTSFNQMISALERMVEAQQRLISDISHELRTPLTRLQLASALLRRRSGESKELERIETETQRLDSMINDLLVLSRNQYKNELLRETVKANELWNDILDNAKFEAEQSNKTLTVTAPPGPWTIYCNPYSLASAFENIVRNALRYSHSRIEVAFTEQNQGITIIVDDDGPGVSPEDREHIFRPFYRTDEARDRESGGTGLGLAIVETAISQHRGHVKADDSPLGGLRVEIWLPRGSVVNKLNNN

SEQ ID NO: 8325 - protein, 177 aa, Proteus mirabilis
VWFIFIMKKVLIIGYNLGGFGGMETVFKKSINILALHTIHSEFIFFNEGDNKVNDDWLVDCKYRRLSSKIKNTKLRRISYAVQLARILKQEKPDIIISYDTVCCYIANLARKIVRSNVYIYSWIHFSLHNLYKSLYLHKADYHLSISSGITQQMYGLGIDREKYLLFIIQYEKVTLL

SEQ ID NO: 8326 - protein, 463 aa, Proteus mirabilis
DVIMALWGGRFSQQADQRFKQFNDSLRFDYRLAQQDIFGSVAWSKALVTVGVLSQDEQAQLEQALYELSEEVTANPHSILQSDAEDIHSWVESKLIAKVGDLGKKLHTGRSRNDQVATDLKLWCKEEVAHLRQAIIELQKALVVTAEQNQHAVMPGYTHLQRAQPVTFAHWCLAYKEMLARDESRLADALTRLDVSPLGSGALAGTAYDIDREQLAQWLGFASATNNSLDSVSDRDHVLELLSAAAIGMVHLSRFAEDLIFFNSGEAGFIELSDKVTSGSSLMPQKKNPDALELIRGKCGRVQGALTAMMMTLKGLPLAYNKDMQEDKEGLFDAVDTWSDCLHMATLVLDGLQVRRPRCEEAAKQGYANATELADYLVAKGVPFRQAHHIVGEVVVSAIEQGKALEELALSELQKFSSKITVEVYEILSLQSCLDKRLAKGGVSQQQVSYAITEAKKQLNMDE

SEQ ID NO: 8327 - protein, 438 aa, Proteus mirabilis
VANIMTQRAEVIRKILRNGPEPARQLANIMNISQPTLSRALKMLSNDIVQIGSGRSIQYALRDGSRGFNSVPIYRINEEGKIKLLGKLTPVYPAGFVMEQVDNVNRYSEGLPWWLFDMRPQGYLGRAYAATYSAELGLPHNPDSWSDIDIIRALIAHGHDAVGNLLIGEQAKKHFLAMPIPAAVARSTTYPTLARAVSSGEDPGSSAGGEQPKFCTYTDRGHVIVKFTASDNNAISERWRDLLQAEHLALKVLGVETEIFDFEGQRFLEIPRFDRVGALGRVGLFSLQALDAQFVGRAREPWPVLVDALIEQKQVQPDASVSTMRRWAFGMLIGNTDMHHGNLSFISRHGRPYALAPAYDILPMGFAPKVGGEIVNTLRPATLLDGISREIWRESLALAEQFYTLLTHCHALSDNFSPCLNALRNHLDEASSRISRLE

SEQ ID NO: 8328 - protein, 175 aa, Proteus mirabilis
RGNMNRIVEKWMYRSRWLFAPVYIGLSLGLLALTIKFFQSMYEILPNIFALSEADLVLRLLSLIDLALVGGLLIMVIFSGYENFITNMEIEGAKDKLSWLGNMDAESLKNKVAASIVAISSIHLLGVFMDLKNIPDNKLLWYVVLHLTFVFSAFVMGYLEKISKRSKRANKANQG

SEQ ID NO: 8329 - protein, 242 aa, Proteus mirabilis
KFDILVINHIWIIRIAVSNNIGVRAKQKEKTRRSLIEAAFSQLSAERSFTSLSLREVAREAGIAPTSFYRHFKDVDELGLTMVDESGLMLRQLMRQARQRIAKGGSVIRTSVSTFMEFIGNNPNAFRLLLRERSGTSAEFRAAVAREIQHFIAELADYLEQESNMPRYFTEMQAEAMVTIVFSAGAEALDIDIEKRQQLEERLVIQLRMIAKGAYYWYRRDLETPLQNNPEIKKKMHQKGDK

SEQ ID NO: 8330 - protein, 815 aa, Proteus mirabilis
PWIMSVVAIKQQAQPTCRQLHKFGGSSLADIKCYQRVVNIMTNYSQPNDLMVVSAAGSTTNQLINWLKLSQSDRISAHQAQQELRRYQLSLIEGLLSKEHAQALSQAFIADLERLSYLLDKPITDATYAEVVGHGEIWSARLMASLLTEQGLPSVWLDAREFLCAERAAQPQVNEALSRPLLQSLLAKYPQCRFVVTGFISRNQQGETVLLGRNGSDYSATQVGALADVGKVTIWSDVAGVYSADPRKVKDACLLPLLRLDEASELARLAAPVLHTRTLQPVSGSNIDLQLRCSYQPEQGSTRIERVLASGTGAKIVTSHDDVCLIELQLAAHQNFEQIAKEVDALLQRVQIRPLATGIDRDSQLLQLCYTSEVANSALDVLQDAALPGKLHLREGFSLVALVGAGVCKNPLHCHRFYQQLKDQPVEFIWHAEDNISLVAVLRNYTASLLQGLHQTLFRAEKQIGLVLFGKGNIGSRWLELFAREQEPLSARSDFEFILAGVVDSRRSLLDHQGIDPSRALAFFDDEATVHSEESLHLWMRSHPFDDLVVVDITANEELAACYEDFASYGFHVISANKIAGSASSLRYRATRDAFSKTGRHWLYNATVGAGLPINHTVRDLRESGDTILSISGIFSGTLSWLFLQFDGSVPFSDLVEQAWQQGLTEPDPRIDLSGQDVMRKLIILAREAGYDIEPEQVRVESLVPAQAQSGSLEAFFENSSVINEQMAQRLAAANEMDMVLRYIARFDANGKAKVGVEAVRKDHPLASLLPGDNLFAIESRWYRDNPLVIRGPGAGRDVTAGAIQSDLNRLSQLL

SEQ ID NO: 8331 - protein, 327 aa, Proteus mirabilis
KYYIMKKEIGGYFELESLINNPWYQTDIKLNSGRAALLLLIKEKNIKKIHLPYFLCDSVKNYLNKEEKNIQISYYHIDDNFLPKIKSENLDKSYLYIVNYYGLIPNKIILQYKKKYNNIIIDNTQAFFQPPLIKVPTIYSCRKYFGVPDGAYLFHEKINIDHLQRIKITNSLAPLTARTEECASKYYQEHVNNENKFENIPIQYMSLFSENILGAINYNYVIEKRNSNFSYLNKRLSQFNKLKVLEKIIPNAPFAYPLLVENAVSLKQILIKNKIYIPTLWQNVIDECAKSSIEYNYAKNILPLPCDQRYDINDMKLIVDIIIKNKV

SEQ ID NO: 8332 - protein, 231 aa, Proteus mirabilis
HQIIQSDFIIFYRTTDQGGQMIKKSTLTQLALIIISIALSLPTLAMAASPSIAHQPPTKDDILYLKQDAPVFETTIPEIRAKFNQNNASLFLNEYKIITNNDITIPLVRAATRITPYLYSSAVLERGSEKIKSLQLTLIHSLDTPQIEKEHQDTAMRYITALVTQFDPSINAAQIQEVLNLFAVKQDVPAYISHNVGAIRYIIAHEDNQLTTFAIEPIKLSLNSNIDSAIP

SEQ ID NO: 8333 - protein, 314 aa, Proteus mirabilis
LSVISMGSAMNIRDLEYLVALAEHKHFRRAADSCHVSQPTLSGQIRKLEDELGVMLLERTSRKVLFTQQGLLLVEQAKTVLREVKVLQEMASLQGESMAGPLHIGLIPTVGPYLLPHIIPELHRNYPKLEMYLHEAQTNSLLAQLDSGKLDCAILAMVKESAPFIEVPLFEEPMKLAIYDEHPWHDRKSVPMGDLAGQRLLMLEDGHCLRDQALGFCFQAGAKEDTHFRATSLETLRNMVAAGSGITLLPDLAVPQAQKRDGVCYLDCTSPNPSRSIILAYRPGSPLRNRYEQLAETIRDHMTAFYEAKKAASK

SEQ ID NO: 8334 - protein, 340 aa, Proteus mirabilis
NSAILSLNPWRAIVKTPIISVIVPMFNEASRITRLLESLLCQTFHDFEVIIINDGSTDNSVDIAMLYCQQDNRFHLYHQTNQGLSSARNAGLKYAQGDWIVFFDSDDFIKPQLLAHWHQLASEQHIDVLIGNGERYDVHNPQKHQTTIHQRQPYQQVISGQEWVIHAVTQHQWPHFVWLQFIRHEIIKKHHLRFIDGLYHEDILWTTQLALVTQRIGFDDQPLYYYCANPNSITRKPNPQKEAKRAQSYLQIVIQLLQLADKQHQPLLANALRQQALRELGSFFILFRKRCDTKNQAIIAQQFSTYHLFPALNKGAQNWRQRWFICRVYCVLYWHRWKKR

SEQ ID NO: 8335 - protein, 104 aa, Proteus mirabilis
RLSVLACSLLNGPDKTRIQPSFPLVTRLSIPENAKVARTDSACSLVLNEPHWTKKRASVVAGFGVVIAGAGSCFTGAEGCEGCTEGAVVVGGVMTTCERGTSPL

SEQ ID NO: 8336 - protein, 109 aa, Proteus mirabilis
NTLVLIFTSSADFEKLPTDNIHTVMLLAAKIPSYMDEYNPQEYLNVNIFGAFNVLEYCKKVKADRIIYTQTVFDISLHSSANITLLPDLEKSLIIKAIMLFMLFQKIQL

SEQ ID NO: 8337 - protein, 330 aa, Proteus mirabilis
ESEVIMVNGIKRIGVLTSGGDAPGMNAAIRGVVRAALSEGLEVYGIFDGYMGLYENRMKKLDRFSVSDMINRGGTFLGSARFPEFREDNVRAVAIENMKQNELDALVVIGGDGSYLGAKKLTEAGFPCIGLPGTIDNDVAGTDYTIGYFTALETAVEAIDRLRDTSTSHKRISIVEVMGRYCGDLTLSAAIAGGCEFVVLPESELPFDRDELLAEIKAGIERGKRHAIVAITEHVCDVHELARFIEAETKHETRATVLGHIQRGGSPVAYDRILASRMGAYSVQLLLEGYGGRCVGIQNEKLVHHDIIDAVMNMKRVFKADWYETAKKLY

SEQ ID NO: 8338 - protein, 351 aa, Proteus mirabilis
LILLNMTINKLINPLSEEEIIKKWNSEEVFVSVICCTYTQEKYIEDPILGVLCQDTPYRYEFIIHDDCSTDSTSEIIRKYADNYPKIIKHIIPAKNIYSQGLKPSINAFSFSIGNYIALCEGDDFWVDDKKIKKQVDILEERKDIDICFSAAYTLEPDGKENIIARYNKNIFVASLSEVIRQGGAYMPTASLLFRRNVAVEFKKYFEKAPVGDYYYQILGSISNGAVYLPDITCVYRINALGSWSSSRLIIDENKLIKELTSHEEHLLKLIKLGANKDDINFVISDLYRIRSNECFLLKKWHIAKKLIEKSWLLHKKINRNQQKLHQYRKFLYILHYREKIKKMIKKIKLR

SEQ ID NO: 8339 - protein, 233 aa, Proteus mirabilis
IMILAVMQPYLFPYIGYYQLAYHSDIFIFYDDVNYIKGGYINRNRIQTRNGPQLFTIPIVKSSSFKKINELYFQEDIRKILLSISQSYSKAPYFSSVYPVIEKILTDKNRNVSNIASKSIIEVFRYLDIDFKYNYSSKIHYNRNNDKNAKDKLIELCKIYKCDYYINSIGGKKLYKKEEFLSNRIFLNFIKPKEVVYQQFNNKNYEPNLSMIDILMNNSKNEVKKLLNEYILD

SEQ ID NO: 8340 - protein, 198 aa, Proteus mirabilis
RKVFTIYNPVRESDITIARDNYTRFLYVGRIIAYEQKNINELFYALSKLNGDWTLDIVGDGEDTDFLKNLALELDIEAKINWHGWQKNVWKYIKENVKYTSALVLSSTYEGFPMVLCEASSYGIFCISSNCPTGPEDIITPELNGLLYPVKDVASLANHLQSIIDGRLLPTHNEIKNAITKFNDENFANRLLSALKLS

SEQ ID NO: 8341 - protein, 74 aa, Proteus mirabilis
QRFSMKKDIHPKYEEITATCSCGNVMKINSTAGHNLNLDVCDKCHPFYTGKQRDVATGGRVDLFNKRFKIPGSK

SEQ ID NO: 8342 - protein, 398 aa, Proteus mirabilis
VQKLNMKNTGHLHEDLYNFARLTLLLPKTRRDTMQNSLPTQTYQSQLNEKTERLQKMMAPFNAPNVEVFSSPEQHYRMRAEFRIWHEQDALYHIMFDQETKQRIRVDQFPVASQLINQMMVALLAEIKDKPTLRHKLFQIDYLSTLSNKIIVSLLYHKKIDETWQQEATALRQTLIAQGFDVQLIGRAYKTKIMLDNDFVDEVLPVAGQQMIYRQVENSFTQPNAQVNIKMLEWALSVTENSTGDLLELYCGNGNFSLALARNFKRVLATEIAKPSVHAAQYNIAMNHIDNVKIIRMSAEDFTQAMNGVREFKRLEGINLQDYQCETIFVDPPRSGLDEKTVELVKNYSRILYISCNPQTLCQNLETLIKTHKISKLALFDQFPYTHHMECGVLLEKR

SEQ ID NO: 8343 - protein, 403 aa, Proteus mirabilis
FLISEQRKEMRKLEHANLLLLIIALVAVGQMTQTIYVPVIADMAVYFGEPTGAVQQVMGAYLFSYGFSQLIYGPISDRVGRRPVILVGMSIFCLATIVAIFSQNLTTLVIASTLQGMGTGVAGVMTRTQPRDLYTGTALRYANSLLNMGVLVSPLLAPMIGGVVAHFFGWHACYIFLLLLGGSVLFSMYHWMPETRPVQAERRSMLSSFYLLLSNSTFSAFLIMLICALSGIAVFEASSGVLMGGVLGLNSITISILFILPIPAAFFGAWYAGREGKTFVQLMWHSVFCCVAAGILMWLPGWLNIINIWTLLVPAALFFFGAGMLFPLATTGAMEPFPYLAGAAGALVGGLQNVGSGIATWFSALLPQHNQFSLGMIMFIMSVAIMLCWIPLSHRFSHQQNTV

SEQ ID NO: 8344 - protein, 61 aa, Proteus mirabilis
SVVSLIVNTKCTFILTTMVFFTDIVDEIKMADYFANFARFVTLVSLFSASAFCRVYFIKAL
